United States Patent 11,180,807 (METHODS FOR DETECTING A GENETIC VARIATION IN ATTRACTIN-LIKE 1 (ATRNL1) GENE IN SUBJECT WITH PARKINSON'S DISEASE) - sequence listing, part 9

SEQ ID NO: 188 - DNA, 4537239 bp, Homo sapiens (residues 3,024,827-4,537,239 of 4,537,239)
  misc_feature (591477)..(641476): n is a, c, g, or t
  misc_feature (902587)..(952586): n is a, c, g, or t
  misc_feature (1160820)..(1210819): n is a, c, g, or t
  misc_feature (1353625)..(1403624): n is a, c, g, or t
  misc_feature (1868132)..(1918131): n is a, c, g, or t
  misc_feature (2071005)..(2121004): n is a, c, g, or t
  misc_feature (2293584)..(2343583): n is a, c, g, or t
  misc_feature (3541742)..(3591741): n is a, c, g, or t
  misc_feature (4141485)..(4191484): n is a, c, g, or t
ttccctgctctatgtgtatcctatgaaaattctaatatatataaacaacaaaacaataagtatttattgtagctttgtttttaacatttacaatggtaaatataaaaatgccaatatttcctgatatgaaaattgatagctttatattatatatataatgaaatcccatatagaaattaaacaaaaacagatacccaagtatcagctggaatggttctcaaaaatatcatagtgagattataaagcatgtgttgaaataatacagagaaaacaataacatcttatttaaatttgaagatacaaacactaccatatacggtataaaatattctatacacagacctgtacttaaaaatagagaaatatacaaggggatgctaaacaattttagcctgtagttatcccttgtagaatttcttataatcttgtttctggttatgttgctgtatcaattatttttcagttttgggtatgtgtgaaatatttcataaaaggaagttggacgttttaataatacattgactttaagaggaggaagaataggtgattggggtattttgttatataccaacacatgactgaaataatcatctattctaattctgttcagttcagtggaaagtctttgaagcttttttaacagagttgcactttgtcatatctttgagaacattgtgttagattaagtggaacaggaatgcttagagggaaggagattaaaataatgtgttgtatggatatttgaggtgacatacaatagaactggaaaataaagaaacttcatgaaaaatagtataaaaagagacataaatgacttaccaattgactgctgtgtttgatagatgggaattgtagtcgtaacattggatgaaataggaaagacagactagtagagctctttggaggcaaattctataagttctttttacattttgagtgaaagttttcacttttaaatgaaatgcatatggataaaaaataaaggtaaatatagttattatgaaattgtcaagataaaatgagagttgatgcataaaaatgaatagactggaaaaagggaactttttaaatataaaaaaaattgcctcttttctgacagtattctttcttcttaaacttcatgattgttcctggaaattaaagtgaaaaaaaactatcataaaactatgactctatcatactgtaacacttcagggcccatattattatacctcctctgtccatctcgcatgactgtttaaaatggttctgtttgatacactgacactcaatttctttttatatggaatgtaatttgggagattctctaaacaatctgtataatggcagacatggagtacaactgaaattagaaatattctgttgtagtttccattctttcttaaaggttttaacattttgttatgaacatgacaagccttatttttttttccacacatagaaggaacacgaattataaatagaacaaaacactgtgaaatactgcaaatgtggaataattatttgatctcatgcacacacctcggtaatttaaattaaattctataagtaaatgactaaatattttaaaattaactactttaaattaagatgtatttagaaataattttaatgttattgaaatttttttaaaaaaactattgtaatataagaaatcatgacataatgcaaatactacatattttcagaaaatttggtaataaatatcatctcccaaaaaaccatcttagtcattgcataaaattctacaaatgatatctgattttaatttagaggaaagtacatgaactgaaagtcccgactgaataaatgcttaaaaaaggatgatttaaaaaaatttaaaggtaacatttattaattaaaataattctgatagaaaatcctaacaatgtacattattgtctagatttataattccgtaaattaaatatacatccccctgcaagtggcaatacttcaaaaattaattctagtttacaatttagtataaaataatgtattagaagtgtccctgaaagatggagtttaatggagaaaaatgaggaatattatgagtatcaggacatggagaagagtaaaaagtcaatattgtgggacaaattaaatgacattaaaaaatcaccttttttcatttgatataatgtaatggttataaaatatctcctcagagttcttcaactgtcatttcattgagatgtggggactggggtctctgaccttgaatctgggaggacttttaacttctttgactaagagaatacaaaaaaaatcaatgctgtgtaacttttgagacctggcctaaatcgacaatctgacttctgctcactttttttcagactcctccatctcaggagggccccagtattgccaggctgggagaaacccaaaccatgaggatagaccacgaataggagttctggttgacaatcccagttcattcctagcttcaaatacacaaggccaagtgccagatatgggcataaaaagcaattttggaagtggacactccagtccaagctgtcctagccctcagctatttgagttgcatccagacatgtaaatcttcccagctgaggcctcatcattgaggtgcagaaaaggggcatgcccactgtgcctgtttctaaattcctgacccacagaacctgtgagcataatacaagtttactattttataccagtaagtttggggtatagtattatgcaacaatacaacctgatgcacaaaaaatctcttctttgttacataaactctatataaactggcatatgcttagttcttaaacctctctccaatctccttctctttccccatactcaaactaatctttttttttctgctccttcaacaaaccagcacttgtatttacacattagataaattgcaccattaacttaaaaaacacaatttccaagatttttacaaaactgtgtcttatagtttaaagtatctcagcctttaagtatcacttgttagataacatttagttgccaatctttataattgctttctcttactctactccttagcttacagtcctttctgccatatttatcgtatttgtataacagatcaaaatctgtggttatctatttatttacctaattttcagctctctccacttattatcatataagttacaaacatttcaggtcatatcttcagtttaccacactataccagtagcttaaatatcacattacccatactagccactcaaaaatatttattatggaattaatggaactctaaatttaatctggtctccaaactaaatatatggcttaagtatcaatataggtttcaggtagatagggtttagctataaggaatacagggtgcaactaaaagcagttttcacaggcaagatgtttacttacttctacaaaagaaagtacaagccaggacaggataagaagagcagcctcacagggacgctgaagatttgttatacacatgcagggacattaatagcatttccttagaaagaggtatgatataagatagcttgatgcctgtagcaccctgagacatgattgctcatattgcagccaagaaaaataggaaaggctgaagcagcaaagggcaaaggggcaaaaggccaaagccatgcaggccaagtttgtgcttttttaaaggctttcttaggaacctatcttatgatatccatttcaatgtcacaaaattcacatggccacaccaagaaacatggatattttactttccaaataaaaaactaggcaagagaagtttacatttgcatagcctatcaatagtgtctgccaagatatttccattttttagtgtatcagaaaattgggcacacatgactaacgtacttttttcattttaaatagaaacaaatgtgtgtgcatatatatatataaaatatacatatttatatgtgtgtaaatatatgtgcatgtgtgtgtgtgtgtgtatgtaaaaccaatcaacttctgctgaaaaacttctgtaaaactcattttttttttccagtatgtttcctctgaagacaatcttcacatctagggaatattaatggtaataataacagcattgatttattgagagttttcctatgtaacaattactatacaagtatgccatttaatctatttctctagtttcaatattaatattggtacttaataaacgagtaaactgaaaataataagtttaaaatcttttttcacagctagtcagcaatacaactgggatttgatatcagattcatacgattccgaagaccctgaccaccaaatgcaaaaggtacatggcaacagctgattgcaatgagagaaaaacaactaataaggcaacaagcaggatactaagatattttccaaaatgaatagcactgattctgtgaggaatgaacattgccaaacaagtgttttgttttgtttttcaactcctctaaaaaaattcacatatatgcatgccactttcctgaaaaatatctgcctcataattgccataagaaacggtatggacaactcttaaacattctgaaagtagtcagggatgggggaaagcatttgctgttttagtctgttcctggtcttataacaaataccacaaactgggtaatttatgattacagaaatgtatttctgaaagttcaggagttgggaagttcaagattatggcaccaacatattcattgtctgatgagggcctgtttcacagatgtcattttgcatgacttaatcacatggtaggaaaagcaaagggacaaaatggacaaatgccatgttgtcacatggcagaagaaatggaagagccaggaagctctcagaagcttccttaattaggatattaatctcattcatgagtgcatagccatcatgacttaattgcctccaaaggccccacttcctcatcactttgaggattaaacttaaacatgaatttggaggaaatatatccaaactctaggactagtttaaatgtagctaaaaaggtttcttcattctgtaatcgttaatatgctaatatttttgtaaatatccaagaggaagctaaagcatataatattccaaaatttatttctgtttgtggatattatgttttcctctcattctatcttaagaaattagtgtcctcaagaaacactatataggataattgtctttcaagttcatcaactaccagttcttgattcttcagtagctaatcctagatagtaatacttaacagattataaaaacttgggtgctgctatataaatgcgctgaaactcccagggaaccaaacataaggacttaaagagagatgtaactagggatcataatcatgaatttcagctgcttctctatctttgtcagtgagcaaatgaccatacaaaataaggtattcaattattaattctgtgcccatatcccggaattttgcccaatatatttgtaagtttagataaataaggcactaatgccagggatatgtagcattagttctgggtttataaagggatattcacaacctcttgccatccacagaatttatcagcccaaagtaaactatactcgttggttaagggcaacctgagacatgtttaaaactgaggtggactgaagagtcaactaattgcaggaatcttttatttggttgaaatgttcaaacaagtcccactctgaattctattagaagtccatcattggcttctctctctttctcactgtcttaaatcatgtattttataacactatgaagaatgaagttcaaaagaataagctaaatttaattaattaaattatttatttatttattttgagacagagtctcactctgtcacccaggccagagttcagttgcacgatcttggctcagtgcatccttcacctcctgggctcaagagatcctcctgaagcagggcatttccctgaccccttcatgggactcgtgacaggggtgccccatttactcagcccactgctctcaactcctcaagggagggagtgcgcaattgaacaaggcaggaactggagtacacgagtgctggaaccagtggcctctttggtgccagaaggagtgaactcacccactctgacctgctgtgttccacctcttgcaggagagagcatgcaggtgagcaggtacaggagccaggaagagagctttggggtgttggcaggagcaaactccatgtgggccccatagcagcccctggggttaggggggtgcctgtgattcctgaagccccagtgggcatattacagtgctcctttagctctgccgtcttcagacagctgaagtgttagcagctcagcatgcctttttgtatccacactcactcctgagctcttgtttggcatccaggaaaaaatcagctcacagaaacgaattgaaggatggtaaatgcagaggattttattgccaaggaaagtggctctcagcaggaagggcagctgggaaggagatgtagcaggaaggtttctggctggactcttctccaaagttgcactgtcaagctgtctctctgaaatcaagctgcttctctccaacgtccaaccgtagtctctgatgcccagctgctgcttctcttttgatgttcagctgcttctcttttttgctagctgagtctggggtttttatgggcacaggatgggggacaggggaggtcatgggtaattttgtaaaaggcaacatttgagtgggaaaacaggaatgtatgttctcactttgggctttggttccaggcttgagggtggagccgttgccagggacctgccctcttttgcccagaatttccctgcctcccttccctttcactcccaccccatcactcccacctcaacatcctgagtagctgggattataggcgcacaccaccgcatctgattaatatttaaattttttgtagagacagggttttgtcatgttgcccaggccggtctcaaaccctgggctcaagtgatttgcccacctcagcctcccaaagttctgggattacaggtgtgagccagtgtgcctggccctaaataatatttatatgggcattttgtaattattattttttaataatataaatgtttcctttttaatatgaatttttcaagagttttataattgactgattattcattaaaatttaatgaaggacaggaattggctatttttctgaatgacaaaaattaggaaatttttagagagatgatgaatttatcctagaatatatggaaagagtaaatcttgttatatagaacaagcaactttccaatccgaaggatcttagaataataaaaattttttttcttataattgttttcttataattgtttcaaagtaatactttagaccaaaaattgtatatctcagtaggtggcctatatgataattaaaaaattaaaagctaagttaattaaatttttaattaatttaatttttattaattttaattatcaatcttcattgaagaattttgtccaaaaaatgtggacaatatgtgtcataaggattaatcaccataaaatagtccccaaaggaaattaaaggactgattagatagtactaaaataacaatcatacaaagtagaaagtggtgttataagagaaatgtagataaaatattgtaagaaactaaagtaggaagataatgttttgagttgtgggagatcagggaaggttttttggaaaaagtaacgtttaagctagatcttagagagacatgacttaatagaaaagtaggcaaaaaaatatgaataaccctttcagattacaggcaatacaaattatgataaatataaaaaaattcttacttcactagtaatcaagtaattgaattaaacaattggataccattttttcttcagcagactggcaaaacataagatgttaacaagggttttgagggtacagggaagagggtaggctcaaactatgctggtatcaatgtataaccaagatctcctttggagtacaattgttatatagtctacattctgtaaaaactaaacacatatgtttgcctttccacttttggaaatacatggtagataatcatgcaagaatgtcaattgcagtattgtgttgtaatttttaaaaatactctagatattcatcaatatataactacaaataaaaatagttggactatcatgcagactacaatgcctctattgtggcataatagttaataatacaatctctgagagcagaatatctggatttgaataatttgctctccctctaaatgaccttgagcaaagtacttacaatctttttctctcttccataaaatggagataacagcattgccaatttattagcttgtcatgatgattaaatgagataatccatatatcacaccaagtacccactacgtaataagcaactaattaaatttgactaatattaataatttcattattattcatcttaatatcatggcatgacttctaaggtatattattaaatagaaaaagataagttttaaactgagccatagtttagaacttgacttaaagcagactcacaaagcaaatgctcatatctaggacaggtaaatctacacgtgtttatacacacattcactgtatttggggaaaatacacaccaaactggaaacactggttgtctctgaagaagagacagggctttggcaatattcaaattaggctttaactgtttctgaaagtttcagttctctataaggagaaggtattacttatgtaatttttaaaaattacatattaagtactaaatgactgaagcttcttagaattgatgggtgcaggcatcacatgggcagcaaggcattcacataatggagaatcatggtctcctgtagatgtctaggagtgataaaattaactaccttttaggtggtgtagtttcctggttgagctgataattattaagttaatgattagtaggttatttctcaacaccgaagagattattagtgtttcaaagttttcactgtaattcatctgtaaaaccattcaacctacctccagtacacctcagtaatctggtgacaagagagtattcttgctcactttatttactcttcagtgatctaatgccaataatgccagcctatagaaacaacagccaattataacaaaaagcacattagaaagtcaaatatagctgggtaatagacataaaaataccttattaacatttttataacactctgaactgaaataaacagaccactctcgattttagcatctggttccaaacaattcttgtttgggtgataactttttaaaaacaaatgttgggcatctttcatcgacttttcatcaagtaacagctgttcctttagagcaaaatgtatgcatgttggaagtgtgactgatgctcacttctgttttgttctgtgtgagaaagctttatgttgggtgcaattcagaaaacaaatggtttcaaatcttttgaatagatgccatagcacagtttaaatgcagcttcttgtgatttttagaataatttcagccacaatttttacattcaatttataactatactaagacattctccttcagaacaaaggcatttctgttttcatgtgctcttgggcatcttcgggtcattcattatatcaatcatttatcttcgtaaagcgtttggctatgaacaattacttactacaccaaagcatgaaagaaatagatatagctcatctgctcttgaatgcatttctacagattcccttaggataattcctgtttcaacttaagctattaaattttttgctgcattcaaatcacctcatctgctgaaacatgtggagacaaataaccacagacgtttgcatgaaggttcaggtgtatttaagggcagcttaattataagacactatgaaattctcctaattaatttggagctaaatattctacatcaaatattttacaaaacttaaagaaatatttacttttcacatgattacgattttgatactaggttaaaaatgacttatactggcattttttaaacagtttaagacaaataatgtttttgatactgtttattataacatatgaaaagtctttatgcagatatactctattttatcgtctgttcatttcatgttgcatttgcatgcactcctgaattacttgttactaaaacatacagaacagacagaaagttaaaattggttaatttctatctaatctggataagataaacacaatgagtgaaataaataattatgtcaaataacaaaaacctcatgcatagaaacttcaacatttctgaataacaaaaagtataacattatgtagggcaatgttccacttttgtatcaactagaaataagccctgaatctgaatgatgaaattttaatagtaactgttgaccacagggcagagtttactctcttggtcagatgcttttgtgaatgacacaaactgtgtgtccagatcacttttccctataatcacttcaaattacttgactttttgatctcttccttttttctgtctcttttttgtccacaacagatattccaaatatccaccgagttttcaaatactccagtccatatttggtcttcccattcctagcagaagtactttgtcttctacttcccagaataatgttaattctcttattttagacttgcttgctttaatttgtatttattcttggctttttttctttccatctcacaggataagagggcatctcttcttccatattcataaatacgttgccaacaggaatttgttgttatttacactttcttctcctagacattttaattttacttaccttccctgagcacatggcaaagtcaaaacacaagcagaatcttacttatgaatagaggcagatttattaagccaggggtaggcaaactatagccaatgagccaaagccaggctgccacgggtttttataaataaaattttataggaactcagccacagacattcctttacatattgcctacagctgcttaagcactacaaaggcaaagttgcatatttacaacacaaataatatggcctgcaagcctaaagtatctactatcgtgccctttatagaaaatgtttatcagcttttgttctcttatcctaagttatgaggcttacatttccggccacctcatttgcatttgagtttccagttttgagtttgtagttttgcattcttgcttaaagagccccaaaccctgaccgccaaattgaatgtgctgtagatcccacaaaatatggatccaatcaagctgatgccatgtcattatctgtagcttttattctttgccatcacacaccttccttgaacagttaggcttctgcaaaaaatcttaaataatcactgatatgggttggttctgtgtcttcacccaaatctcatcttgtagctcccataatttccacgtgttatgggaaggatccagtgggagatgtctgaatcatgagggcacgtatgtcccatgctgttcccatgatagtgaatggatctcacgagatctgatggtgttaaaaatgggagtttctccacacaatctcttttttgcctgctgccatccatgtaagatgtagcttactccttgccttccaccacgattatgatgcctctccagccatgtggaactgtaagtccaacaaaccactttctttcgtaaattgcccagttgcaggtatgtttttatcagcagcatgaaaatgaactaatacagtaaattgttaccagtagagtggggtgctggtggaaacatatccaaaaatatggaaacgacattggaactgtgtaacaagcagaggttggaacagtttggaggactcagaagaagacaggaaaatgtggccaagtttggaacttcctagagacttgctgaatggctttgaacaaaatgctgacagtgatatggacaatgaaatccaggctgaagtggtctcagctggtgataaggaacttgttgggaaccggagtaaaggtgaatcttgctacattttagcaaagacactggtggcattttgcctggccctatagatttgtagaactttgaacttgagagagatgatttagggtatctggcagaagaaatttctaagcaggaaagcacttaaaatgtgaattcggtgctgttgagggcgttcagttttataagggaagcagagcataaaaatttggaaaatttgcagcctgacaatgcaatagaaaagaaaatcccattttctgaggagaaatccaagccagctatggacatttgcataagataatggggaaaatgtctccaggacatgtcaaaggtctttacctcagcctctcccatcacaggcacagagacctaggaggaagaagtggttttgtgggctgggcccagggttcctttgctgtgtgcagcctagggacttcatcccctgcatcacagcaactctagctatggctgaaaggggacaacatagagctcaggctatggcttcagagggtgcaagccccaagctttggcatctcccatgtggtgttgagcctacaagtgcacagaagtcaagaattgaggtttgggaacctctgcctagatttcagaagatgtatggaaacgcctgaatgccgaggcaggagtttgccacataggtggggtcctcatggagaacctctgctagggcagtgcagaaggaaaatgtggggagggagcccccacacagaatccctactggggcaccacctagtggagctgtgagaagagggccaccgtcttccagaccccagaagtgtagatccactgacagcttgcactgtgtgcgtggaaaagctgcagacacttaacaccagcccatgaaggcagccaggagggagactgtaccctgcagagccagaggggtggaactgcccaagaccatgggtatccacctcttgcctcagcgtgacctagatgtgagacatggagtcaaaggagctttagatttgactgcccttctggatttcagaattgcatggggcttgtagcctctttgttttggccaatttctcccatttgcaatggctgcgtttacccaatccctgtacccctataaccccattgtatctaggaagtaactaacttgattttgattttgcagggtcataggtggaagggacttgccttgtctcagatgaaactttggactgtggacttttgagttaatgctaaaaagagttgacattttgggggactgttgggaaggcatgactggttttgaaacatgcagatatgagatttgggaggggctggagtgaaatgatatggtttggctctgtgtccccatccaaatctcatcttctagctcccataatttctgtatgtagtgggagggacctgatgggagaagactgaatcatgggggcaggtctttcccatgctgttctcataatagtgaatgggtctcacaagatctagtggtgttaaaaacaggattttctctgcacaagctctttttttgcctgctgccacccacataagatgtgtcttgctcctttttgccatgattgtgagtcctccccagccatgtggaactgtatgtccaataaacctttttcttttgtaagttgtccagtcgtgggtatgtctttatcagcagtgttaaaatggactaatacaatcactctatcaaatgagataatatttattcctttaccactgacaactctctctcggctcttctattcaatcatgttactgatagacgctttgctttttgtttttgttgtttaacctgattgttatagcttattttatgaatttctgttcttcttttaattttacaacaattttactatttctccttacatgtttataagtcatatggagactccttctcatctaccctgaccccagaatattaaaacttttcagagtttcaggattaattccattatatggacatgattccttgagataggaaaaactgattggattgtgacattagacttatcagaatctaagatcttacaaaatataaagctttactagtaatttcacgaactcaggtaatcattaggcataggcaaatcagagaattatttagatctcttaatctgattctttagatccttggttctgtcattagatactcccttgcccaggcagatagatgagacttctagagaggtatgcagacaatttatttacatggagatacctgtctcaattatcaaatatcttaatttttatgcagatagttacatatgtggtatatgtgacattttccagggagccccataaatccacaaccttctactttgttaaccataagcaattctaaacgaccaagtacattctgctaaaagcatttctgtgatagataatcactctcctgccagcaaaaaaacaaattgtttgtcaggagctgtcattagtatgtttatataagcaaaatgggcttccttccttctgtggatcctggcagggcatctcagtaatcagaaagaatcaaagaccctttccttcccaatctgctctggccttggtcaacatcttagtgccaaatattgctggtgtattatcattattgtcttacaccattttctgcagtgtttcacttaagccaactaatactctgaccttgatttgaaccatccaacagagagtaggaattccctccacaaagcatgttactcattaacatcttcctttacaagtctcttgatgttcattcacaaactcaattacctttttcctccatcaacctcaattatttgcatcattttccatgggcctatgggagtatttaattgaatacatattttttcttctcaaatcaaattttctgaaaaaaatttgtttctatgaactgtattttaggtatattccaggttggtacaaacactaattttcaggggtcattatgtcaaagagcccatccacaccccatggcctacatatgtcaaaggattgttctttattcatccactttctatgaattccacacacgggagataaacttctttttcatccatattaccagggttgtcagggagcaacactgaaggtcacagtgttcagtgaaaccttgccataacttagactaaacacgtttttcccataattttacttcttcaaattctttctttttctttctttctctttctttctttctttctttctttttctttctttctttctctttctttctctctttctccttttctttctctctctctctctctctctttttctttttctttcttttttttttttttgacagggtttcactcttgtcacctggctggagtgcagtggcacaatctcggctcactgcaaccttcacctcacaggttcaagcaattctcctgccttagcctcccgagtagctgggattacaagcacctgccaccatgcctggctaattttgtatttttagtagagacggggtttcgccatattgaccaggcttgtcttgaactcctgacctcaggtgatccacactcctcagcctacctaagtgctgggattttacaagtgtgagccactgcgcccgacgttgagcttgtttctttatgaattcctgcaactcaacattaaagacataatatcccatagtgattaatatatccaatagtccttcctgactaaaggtacaaagttaatcctagtgttgttaataagcatggaagtcattatttattcagtgtcttcggttcaagcattgtcttaaaccaaactgattttctactacaactgagtcctctaaaaacagcttcctctagtgtccctatttgaagtagcaagtcatttttatcataatgatgggcctcctagaacactacttcaattagatttaatatcacatgaccaaatcctgtaattctttcaaaatgcctggcaaaggggccagtgctgcttaacttgccactcatgtagttcatattatgtgctaattaaatgtgtctagtttgaaagcattgtctacacctacaaataatgtgcttcatgaaattctcaattaggtatatcctagcaccagataccgttttatctggctgtgccataggcttcccttaaatgtcctctacttacctcttgagggagttatttataattttaaagcattaaagcaaacataaaatcacattctctgaggctttctaggttctagttttatattatttaaattaattccatttacattcacactgatatgttcaaagcaacagaccagatcaagctgtgacataccagacaggcagccactatctgctttctatcataaccagggagctgtcttagcaatgtatcattttgatttatggccatatagggtgcagaaattctattctacagcatcctctgctctgtacaattcattggtagtttctctggaaaaaaataatctagaatggtaaacaaagcctagaaactgagtgataactgtagtcaactacacacaagctgagttgtcagggggcactttgtcatctgttttattcaaattatacaggtagaacatccaaatcagtaggagtccaattttccttttctgcagtaagcaggccaagagattttcaccaacaaagcccatttgtttggatgacaatagcaaaagatagttaagtatgatatcctcactctgagctgtttgcatgaaaatattgtagtggcttccctccacggtaatgtaatctacttataaacacctttcccatctgctatgattttaccctatttccaaatgcttcctcccaatatcaggctgtataactcatcatgcataatgtttgcccgcacaatcaataacaagaaccttactagcacacccaaacaaatgtttgggttttatttgtttgtttgtttaacttttattttaagttcatgggtacatgtgcagatttgttacacaggtaaacttgtgtcatggggtttgttgtcaaacaaatgttataagtgacagacaaaggacctcagaagtctctcctctgcttgataatggagctaccttcacctttagccctaattggttacataggaaggaacttttgatccaccacaaattacctttcagaaaaggcacagtcaaattaaatgacacaaatatcatgtcttgggtattgtataatcttcctctggtgcaagtaaatttaaaactgggtttgagaccgccattagaggccaaataaaagtattagaggtgggaaagatataaagttatatattattgcattctccttcactccctcattattacctcttgatattagtaaggcacagtggattttgttatttatttctcatattagtctcaggacgcaatggtttcactaaatgaacccttaataatttttgagcaaggggccttgcttttcatttttcactgggttacagaagttatgtagctggtccttcctgttgacattggctgtgtcattcagtgcaacagcatgtgtctttcaaatggattatagcaaacagctgccacaggcatattttgagtcaaaatcctaaggagtctaaattggtggtctcatttaacttttcctaaagggctctagtttgggtatgccctaatatcatctgaccagttggatgggatcataagggcctaatgttattgcctgtgctaccacctaccacgatacttttcatgcttatttctgttcagtacctgcagtgagttaagtagtgctcttctgaaattattattcattcagaatctcagaaggtgaccttctttagaaatttgcacatacaattagttaagatgagctcctactagattaaggagggtcctaattccaatgactggaggtgtttttataagaagagaggacacatggagaagagattgaaaatgaaagcagaaattggagtaataaatctataagtaataaagctccaaaaatttgtaggagagagtagaacctaggcaggggcaagaaaagatttttttctgtggcttttcaaggaagcgtgaccctattgactccttggcttcagacttctagcctccagaactgtgaaataataaatttcagttgttttaagctacccagtctgtggtaatttgttccagcagccctaggaaagtactacaatgctgtattcacgttctgaactctttccagttattttgtgagtatgggtagacaagattcttagaacagtcttgacagtctctgagtttattgcttattggtgggtcctatgaaatataaattacttctcacagtttaaggaatgtcctaagttgatctgcactaatttataggatttagttggagtttaaggaatgtcctaagttgatctgtactaatttccaggaattaatttgcaccttgggctgtgccttaaattctagctggatttatcagccagcttctatttgtaatacaggtgactatggtccttaactcctctcctaatttttgctctgagaagaaaattatcatcataccatgaaagtagtagatgaactctatcttttaggttattctttaccagattatggaaatgtgataatgaatttttttaaaatccatgataagacagtaaacatatacttgtttctattctgcaaagcttaaaattttcctacttgaaatttaaaaaaaaaaactcttaggaggcccctgagattggtttaatgctctgttgtagctatctggaaattcttaataatttttgagtaagtatccatgcattttcattttatactcagctctatgaattatgtagttaatcttgataacatatcagagcctcttgtctactttattttctgtacattcttcatcctatcaggtacagatgaagcacgcaaatgaaccaccttgatactctactgtaaatgtccaggggctacctacttattgaccagttagaactacaaaaaggaagttaatgtggggaggggaacttccttctgaaccattttcttaattacaacagtagtctcttattgcgcccttggaattctgcattgcttaatatttactactgtggagagcttgagcaattccaaaggatcccatttggcagagctgattaaaatttggtgaagagtgagctcagtcttcatcctctgtggaaacacaaagacgacaatgtcccattcatactgaatgacaattgcaattttgtatttatgtaaaggtagcacaagcaggtaatattctctccaaccacacatttcaacctgtaacttcatctttaccttggtttcctccctgatgttctcttcatgcactccagatttcacttagagcatgtatgagactctttcctaccttccataaggcctactgtaaattctgctctacatcctaccaatgataagaaactttgaataccaccccaggtaactttgttcaaattatatatatggcctcagatccatgactggggctggaatgaacagacctcagttctttatttaattgttttcagattctacggctttaattaaggcagtaaactcagccccctgttcaagtatgttctgttctatatcactatcctcataattggatttgaactctttcagccacaataaataaagcaaattttctatgattctttaagggattggtgggggctacagtactcctctcctctgattcaaaagttgataatgtgcttttattttcttattaaaaattctatcaaggcttactttttaaatcctatttatattttcttcaaaagtaaattaattcaagtgagctgcctttctattttctcttctgatttttaatttctccctgttgtgcacatgatataaatgctttttctccgtataatcccatgtatagtaactaaacctgtatgtttgttactgttctctgaatatatatatttggccctcaaggttatataagtcttgtaagacagagaatcattagcttatcccattcactctatctcttattatttgtatcaatagcattaactaaggtgttttctctctggaaaatataaagcctgtcaacatttacacttgtatcattcctatcatgtgaaaaggagaatccaattggcaatttggagaggagtagtagcagttacccttctcagtataggactgacaaatctcaccttaacaactgcagccgatatgctgtcacagtatttggaagtgttttctcaaaagtttacagccatttaatgattagccatgaccatgaatagtcctttgcatcagataataatagaattgcaacatgtcctccatcattaatttgaagaatccatgccaatgttaattcaccagtcttctgttagtgaatactctgttctttaataaaatatagttttcactcatcacctgtccttggactccggttacataaatagtttgtccaataatcaatattttgagtcatttctaaggatacatgaaatttctccaagaaaccagggagggataagaaggttttccagtgaataaaatgtaatctcgcagctttttctcccactatcatctcctcctattaaaaactaacctattaaaaggttagcttttacaggtatgctagcaggagtcagtcaatgggatttgcacccaatttccctttgtccatgtactccctagacccgtactcccagactgtagtctatggcccccagatttcaatggtaagacttatttcccttaacctgcctcaaagattccactacctcataccaaaaatgtacagccaactatcctgagaacaaattctcatatttttccattatttccttttgaaaaggagcccaggtagaaaaagaaaacattcactattttggtgtgtgggtctaaaagacaatcctgctctcagtgccaatctgaacccacaaaaagcattgaattgtcaaatcggactcacattgaagattttgctcagtatcatgctttctgaataatttcaaagataaaataatcatgtatgggttaagtggggagagacctgtgtcctttcatcttcattgaatgtggtctcatccaagtttctagatttggtttctaagtaaaatgtacagttgctttacttactcaggtgtattctcagttacaaaccatctccttttatacttagatagcaacacagctaacgtgacattttcttgggaatcatcaccctacatttattgattcctggcttatttttcataagcaattttagacaactctgcatggtctgctagaaacattttatgaagaatgattctttggctaccaaaaactatttagtttattttctaagagacttgcattaatatgtttgcagaaaaattaaaccagaacacctgacttctttatttcccaggagttttcctccacacctgcccccatcaggggagaaaattgatcaggaggtaccacccctttccacaccattcttgaatctattctacagaactctctcacatggtctagcaatatgtttaaggtagaaccctttttctatcaatatttcttatgtgttaaatttgcattattatatgttgactagaaattatatattccttcttaaacattaatcataatgaatctaaaaacctaatttatttcaaccaataaatttctctttaattcctgtcctcaacattcttgtcctcaatattcctattgttactgttacagttatgaaatcatcttaatgaaatcacagctagaccagtgcattaatttaaaacaatagcatcctttttctataatttaacttcttcaaacttttcttcactgttgtataatgataattactctaaaatgacaatctgatcattaaaactttaatcatttactctctgccaatttcataaataaatatttgattcacagttgttatttcttcttcaagatacatcaaataatccacctttatgaaaagcaatttactgtttcataaatgtgctttattatgtcacatattcagtcttttaaacattttgtgccatccttggtcatcaaataaatttctatctactaaacatgactgacttagcaaaacgatagccttagtttcatgcatgtctccatcaattttggaattgcttttatgcccaaactgcagtgggagaaaaacacacaacaaaattgtgttgattgttatctctttaaaaccacaaccttgaaaagcaaatgtgcctttaaggcggccaaacaagcccatttttcttttgttagccattgccttcttcctcttatgtaagattaacttatggattctttcctcatttcacacccctcacatacttttcttcaatctcaatgccagctgatgaccttgtttcctgtgtcaaaaaataaatacatagatagataaataacaatcaagaggaaatgtatgcagactcccactactacatatacttaacgccagtatctaaaattacacactactcatcctgcatattaatagagcagggtcttttctctggtactatggacaaactgagccagataattctatgtttgggatggggtgttggaaaggttgccttgtatgttgcaggatgtttagcaacatccctggcctctccaattcgatgctagtagtaactccattcacaagttgtgacaacagaaaacatctccaaacattgccaattggctccttgcagagtgaaatctctccttaaagaaaaccactgccagaaatgaaatgtttatacacctacctcaagcttacgcctttacttgttcatcaactctttctgactacacaggctatagacagatacttttcaatacttacccctcttatacataatcaaattttcctctttattgggtcatttcatgatcatacaaataagctattacttctgtcatactagaaaataaaagcaaataagcaaccagtattcttcattttccccattttcattgtcagataccaccagggaatttgatccctttttcaccaaaactctttaaaaggataatttatagtcaccgtgtcatttgctccttgcattttctctttaatcatttcatttccatacagatttttgccccccactactctaattaaacctgtcctccactttgttaatcttatagttatttttctcaccttacttgatttatcagcagcatttgaagtagattattctcataatactatcttcatttgactccctggttttatattatttgtatacttctctctctctctgtctccctctctctctctctctctcttttagtgttttcttctattcctcagactcaatgttggaatgctccaggcctcagtattttatttccccccaccatcatctttctctgtacttctttccttggttatctcatccaatctcgtggttttacatgcagtgtaaatgctaatgactcccaaatttatatttccatgccatatctctatcccaaattccacacgcataaatccaattgcattttttacacttccacctgaatgtcgtgatgataatgggtctatttttcctgagacccattcctcactctgcccagttcagttcataagacagaggggatgaacactgtggattatgtagctcagattttctgaaagctggcttccagttaggctcaaacaataggagacacatgtagaaagatgaaaggcaggaacaaggagaaatctagatattgtctcattttctccctgtcatccctaataacagttacattttttacaggctcctgctcctttacataggcccactgtggttccagcttcccccaaatatccctccctgcagctccagtagtacagcctcctatccctgttctccaagggaaggtgatagtagcctcccattgttgctaaattgtaggttgcctcactgtcccctggttggctttaatttttttaaagttatttctaccatcaattacctgtatcaattccctttgttttaaattctcaatgatttcagttttcctggctagtttctgattacttcagatacctaatggaaatctcaaagaaagtatgactcaagagaaattgttgatttccatctcccagctactaccaaacctgtttatgcttatccatttcatttgatggcaagtccttcctctggttgcttaaacccaaagactttataatatgtagaatcaactacttctcaccatgtctactgaggtgtgaattactactgttttcctcttggataaagtcaatatctaaagaggggacttttcctaaaagtgtcctcttacagtcagttaccaacacaatatccacagtcatcctttttacataaaagagcgtgtcacttctcttcttaggacctgtagtgaccctctctttcattgatggtaaaattctaaggcagtgtgagttttaaaataccctgtaaatatgtacaattattatgtcatttaaatataatatatatttttaaaaattaaaaacgtatatcaaggcccaaattacttctgtgtgctcatcgttaactccccttcctcactcatctccagccacactggtttccttgaaccccttcaaacaagccagatatggggctgtcttgggcttttgcaccgtcttttccctctgcctgggttcccttctttcagatatctacatgtttaatccctcaccacctttaaatttttgcataaatgctatcttttcaatgatgttttctatggcctccctacttagcatctcaacctgtttcttggaccagcattagaaaatgaatatagagagatgaacacaatatatatggccctgccctcatagtcctagcaatctacagggacacaaaataatatgcaaaaaagtatttgaattatcttcagcacctttctaaagaaaaaaagctacttaaaacttacacttagaaatgctcaatatgagtcaatacattatgtcaccacctaaagtaacaagatgttaggctgcaactgctgtatgttttgaatgagactcattacactatgaagtcacatacttgtttaatattataataagacagaactaaatttaaatcatagttataccaaacactagctacactgaatctctacatctcaatgttctcaccagcaaaatcaagcttataataatactagcttcttcaagttatttaaaagataaatgagctaagacatgtaatgctcatagcccatttagaaaggcaaaatataaggtgtagtacatagaaaccactgaccattggtaattctgaaacactacaggtcagacagtttgaatgaaccatatactaaaggttggaaaagttatttgattaaactctgccttttttttttctgggaagaacacatagattaatcactttgtataatcccaacctctcccttcttgggagtggggataggggaaacagttttcatcatctatgatcttaagtttcctcatgctctttctcattgttaagacaataccacttattttagcttattgttacaatagtatttcatttttttctaacaacttggtattagtcaagatgggatataataacaaatgactcttgaaatcttcatgggtgccatgggaagtttcaagaacacaacttgaaagtgaattgcatgactttgttctgtgtttcattgaccactactcattcagtgagcctgaaagtaactgtgtatatcactgttagtatactatgcatgccagatacccaagactcaaacttttcctttcctttagataccacctacttagtcatcaattttggttcaacctactccactaaatagctttgacttccattcacttaccactttagattagtgctatagactcctattttacctccttcatatcaatccccttaaaactcccaatagcttccattgtttcaaccaaaagctcaaattcctttaatataaagtgttatatgaactggcaccctatatactctatatcctaatctctcatctttcatttatttctttaactcctgactcatgtaacaaaaatgtatttatctcagcacgtatgtactcccttgttatgctctcccaaatgtccctgtatttttcattgaatagcaattgccacattttattttatatgcttgtgttaccatttatatatatatttactacagactctgcttttagaaggcatacactggccaggcgcagtggctcacacctgtaatcccagcactttgggaggctgaggctggcggatcatgaggtcaggagatcgagaccatcctggctaacacggtgtaactccatctctactaaaaatacaaaaaataagccgggcgtggtggcgggcgcctgtagtcccagctactcgggagactgaagcaggagaatggtgtgaacccaggaggcggagcttgcagtgagccgagatcgtgccactgcactctagcctgggcgacagagtgagaatctgtctcaaaaaaaaaaaaaaagaaggcatacactgtgatatttgcaacatcaaacaaacaaacaaacaaactaaaattggaagaatacccaaaaataactcaaaggaataattttaatttcaattaattgattatggcctttatcattttaagatttttatatgtctacttttatgaactctaggctagttttttccacttttatttctacaatcatggggcctattttatattttctcttgcacttgattatagaagagattgaaatgagttaggaaacatgtacttgaaaccaataatgggcacactttacaggatttcaaaatctaaaaatatcataacataacttcagggaagagtaagaagtattggtgtcatttttttccttttagtagattagttgaagaggtaaattgaacatggactatatgtcagacttttttttccaaattatattcttaaatatatagtaaaacatatgctagagacagttttttaataacaaacaatatttgaattgagatcctgaagaaaaataaattaactgtgtaaaaatgtattactaaatatctgcattttctagagatgtatccttaagtatgtaggtataaaattacactctgagatatatttttaaaataatttggcaagaagagaacagggataccttaagcagaaacaacaaaattatgataattgttgaatatgtgtgatggttgtatgttaatgtattgattattttgtgtgggtatgaaaacatgataataaaatcaaattacaaaaaaataaaaaatacctcttgcttttttagcagcttattacattgtttataacagtgtctacagcgctatgattggtcagagccagagactataacatttaataaaacgagtcctctagaagctcatgggagttcatttacggcagcaaagacctatattaaatggactgaatatttaaggagtaattatgttgagtaatgtgtttatttatagttttaattatacattatcttttttggttatctttaaaatatattaagcttatgcaaataggatatgcatcataacccaggatctattatctgaattgcttatatacttataataacataactttaaaagaaagaatcaaaccatattgctagcttacaggttggatctttctagacaatagttatttacctgaatgtttatttttgttttgcatcttcatcagttaaaaccaacagttacaatacaaatgaaagttaaaaaataataatattattaatgtgaaatttcaatgtgcttagcaataaataatgggaataagaattatccaggatgtactaaatgctacaagaattatataagtctaatgaacatgatgcttttgaacttaagtaaattctatgtgcttaactatttttattgtttatagatttaggacttctgaatgcattcttttttgctgttatgggatattatgaattcaccttagtagacttttgcttacaggacataaaattaatttattctatgaattttttcttcttttcctaaaaatgtgtaagttctgtgatttcttggactaaaagatatctatttacatagtgaaaggccaggccttgtaaagatcgtgacagtattcaatcctattctcgtttttttgtttcaatgtgttgctagttatcttatctcagtgtattgtatttatataactgcatatttgattaagatacctaacctatgagacatattaacataatgaacacatgtaagcacacaacccaatttaagcataagaacagtatcaataattttgcagttatctttcactctttttcagtcacacagagacaactatactcttaattttgtgtttagagtcctctattttcttaatagacagattgcacatggttaaaggtctatgtttacatcaagagagcctgtgtctggatcttgttcaccccgcttatgtctcttttgaagttatgcttaagctttatcccttgttcctttatggaaatttgagtattttaggaaaagtaaaaaaaaaaaaaaaaaagaaactttaaagtagaatgataaaatctagtgtttttagatacagaagtgagaagctgaatacgggtaaagcatgatggactatgggaagaacggaatttcttgtgtgtgactgctcattcaataagctatattttttaaagacctgaacaggttatagctattggttatctacaagtggaattctcaaacacgaaaatgaaagcctgacaaataagatgctaatgccattttcacttaaaaaatagaacaagcgaaagagagaaataaaagcactagcccagtaagaacatcttctatttgccttactcataagccatttcagggccatagctgcaaaactaggaagaaactgctaagtgctaaaacattttaaccaatcactttaagaaaggcagaggaagcaaatcactctagtagataaaacaggagagactgaagttgctatagttgtaatctttttaaaaataatctatttgttttgaagaaaaccccaataggaaggtgttttcatttttaaaggtatctctcttcagatactatttaatactcaatgtgctaataatgtcaaaaattgttaaatgcgtatatatctgtatttcaaataggatagtttatcaagtcaggttttccaagaagctgatactatgcaattataagtcactcaaaaggttatgagaggaacgttagttaaagattaagaagaaaaagcagatctaagtgcagggagtcttcagtgatgcaagcctggcttctgtcaaaggaggggaagaaggatgagaatgaaagagtcacagcctgaaacacagtttaggaagttttggcccggacaataggagtctccagtccaaagtcttctgttggaaggttatcacaaatcttaaaaatggccttcatcaatactccgagcatgctcagtcattggccaggaacagccagagaaaatatggtctgagtgcaaagatagtcatacaaccagaaaaacagtagctggggctgcctgtcatccatgctcactgaagcaagagttgtgagtggtgaccacatatatcaaatatttctatgaaaaaaacaaaacaaaacaaaacccaatcaagtgaaactccaaaatgataacctttaatgcttattaggtggcacaagtgttaggttgggtattttactaaatatttaatcattatatatgcacatatttatgggcatgtgagcttaatttctgtttttaaattcagaatgcttcaataataacattgcattttatataatcctgattttcttttttaaaatcagctcaaaaggagaagttaaatattcagctttaatttcaccagtagatttttaatgttttgtaatcataatgtttaatttgtgctgttcttagaactttaattatgaagctaaattgtactaatacccattaggtacttcttaattgaaggcacatcatatgtctgatgtggcagtactaattggtgtaattaaattctaatatgcttcagtagcctgatttttttaagggaataaaaagctgatagaaataagtcagctcttgaagctgcatagttgtataatacatacacgtgtttgcatttgtaacatgcacatttattcagaagaaacaactcattaatttattccaaaaccatttcacctgataacttaaaatacagagtaaaacaaattggtcaggtaaatatacatgtaacttaaaaagaaacagtcatgtactttaggcataaggacaatgcttttctcttttacaaattctaagttaggtcaaattctctgaaagtcactacctttctttactgtgatgtgttttcggtgaagttacagcctatttgcaaatcacatcactggtttgtccaagcagaggtagatgagaggtaagctcctgtcctgctaaaagtctcctaaaaacagcaagaaaatatttttacatgttcaaaaatgctcatttatttatattcctaaattttcttttactcagtataatatagataatttaaaaataagtagaatatttttattatatatgttttatttttatacatctagttaaattaatagtggaacattatatatctgttaaatgttttaaattacatggaattaaaatatcaaagttaattatgttattataatttttaaatttcagaaaccttctttaaaattcttactgttttatcttaaaaaattcatatagaaattgtggtcagatgtaaactgtgactctgagcacaaatcccaatgctattgccaattaaattccaatttttgtgttcacacatgaaatgtagtttttcttttattgagttttaaaaatctgtaagatttacctatctgaatatacactcaggtctagcttcatgttcctgtgacctctgtggtcacacaaggacccatgtacataatgacctcatacttggcctaatgctctgctgttgccatcttgaaacgcttaacactttgaacgaggtacaacatccacttcattttgcactgggccctgcaaatcacgtagacagtcatatatgagtccagtattttcctaccaccagacattttgatgtactgaagagataaaaaaaaaaacctaataattagaagttttaaaagaattttttttttttttttggaagactagagttttattactgaaatcagtctcccccaaaatttagagactgcatttttttatttttttttaatttttttattgataattcttgggtgtttctcacagagggggatttggcagggtcatgggacaatagtggagggaaggtcagcagataaacaagcgcctctgcccggccgcccctactgggaagtgaggagcccctctgcccggccagccgccccgtccgggagggaggtgggggtgtcagccccccgcccggccagccgccccgtccgggagggaggtggggggggtcagcacccccgcccggccagccgccccgtccgggaggtgaggggcgcctctgcccggccgcccctactgggaagtgaggagcccctctgcccggccaccacccggtctgggaggtgtgcccaacagctcattgagaacgggccaggatgacaatggcggctttgtggaatagaaaggcgggaaaggtggggaaaagattgagaaatcggatggttgccgtgtctgtgtagaaagaagtagacatgggagacttttcattttgttctgcactaagaaaaattcctctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccaatccctaatctcaagtaatcagggacacaaacactgcggaaggccgcagggtcctctgcctaggaaaaccagagaccttaaaagaatatttttaagagttgttgtttgtttgtttgttttttaatcctagatgtctcaagcttgccttccattagataatgcagtaaggaacccccagtttacaacacagggcaggcaggaagacaaccaactcaatgggatctctgtcctgtgtagtcatcaccagctgatccttctttttctccgctaaggtggtgacagcgttaacccccattaaaaggacaggtgatctctcagtggggatgtctcctttgctttcttctcagcccaggccaacagtctctgctgcttctcttgctttgtctctggtctgtacttgccagccagcttaccccattgagcagctgtttggtggtccaaggccctggtgaactgactaatcacagaaggcacttctagctgcttatagaggatggctctctgctgctgcaacctagtataatggggccatttgacaaagcaagtgaggtcccttttgggctggatgttctgtccaatgccaaaatgtcctgtccagtgccaaatttctcaaatggaagattcaccactttcatggtctcctgctttttcaagaccgcaagggtcagcaccaccttcttccctttggccttctttctttttcgcaccttgggtagctggagaacagaataataagatcttgagagaaaaataagttgaagccagaggtaaaactgaatattggtaatatctttttgttttagggttgctttccattttagaaagtaattcagagtgttattttttaaaaatcatatatcagagttctctaataaatttcaaacttaaaagaacatttaacttcataagagaagagaaatgtttcatgaacatattttaaagatagggaaactagaatacaatttggagtaaaactaatattttaagtaacctggagataggactcatatcttttaatagaacatgcattctaacaagccagtgatttttcaaagttttctaaaacacttttctcaaaccacatttaacctagaagtagaaacaaataaaagacacaaaattagagttaattttattgtaactgggttggctccagagattatagttaggaagtgattacattaagctctacatatgcagcattctagcaaatttcaatgcagtagacaaaatctataaataatgtgaaacacatattaacatgttaagcataatatgcattcattgtcttcaacagaatagttctctattaattttttaaatgtaatacaattttactttaaaaacactgaaaaatcaacatatttcattaagaaaaaattataaatgttgcaaaatgatgatgaaaatatgtatagtaataattcccaactataacaattttgttttatctaatactggtcagctttccatgtgtccaagcattacaggacttttcattaagcctaatcctcacaagaacattgctttgagcgatgttccagagtggtagtcctttaaggcattagaacgatttgtgaaatccctaaaaatactaggggaaatattcaaaaaatgacaatagtgccattattcctcctcctcaaagagactatcagaactaaaactctttgcttcatgttcctgtttacttctgtcactttcaagtcacagaggtattatcagactgtcatcattgtatgactctgcttttccaacagaatcaattacctatcccttatctcacaacttgatagtgatagatattgaatgcttatgttctgattagcaaactctttttgcatttttaataacaacttgaactcctgatatgtctggaaaatataaccccttcaacagccctttcaatgggttgctactattttgctcaccccatcttcacctgcctaatcatgaggaggcggggtatatacaatttcagttaatttgtagttatcagtctattatagttctttccttctgaaaaccaacaagtaaataaaccagcaagcatcaccaataaactttgacagtttatggttcataacgtacgtctacaccaaactttccattcaaatgctttttcaaacctttgtttggtttctttctctattaagacaacttttgcttttggctttcaaagacattctctccattataaactctgtcgttattctctattgtgcttacctcaaactggtaactctttcaaatcttacctgtcagtttcttgaccaccatgcatgttaataacatttcttctctattttagacagcaaatgtttctcaatattaaaaaaaaaaaaaaatcctactctttggtcctctctacctcccatttcatccaatatcgcttgttcaagacctgaactcgtacaggtttttaacctgttgaagactgtcactctatggactctactctcttctctctcctccatagccttctcattgcctatcttccctacttgtccaggaaatgatgacatgtttcatcactataattaatccatttcaaatggcctttatgccaaatgattttattatatactctttctgtgccatgccttgttttccaaatttaccacagtacaaattttacaattagttttccattactgaattagtaccaatctctgtcttaaaaaataaatacagtaaaaaatgataatgaatttatttcttcttataatactatcactggtgcatggttagaataaattaatcttaggatgatataagcatttctccaaatggtcttcaaattcattgatttttttgtgatttcaatttccatatttattgttcctgttgcaattttttcagattttatatgtattaactcagaacacatacctcttatcacacatattttttcatgtaatttatctaaatcttatagaaaagggtacatttgcattttctcttattagactcctgatttcaaataatatattacttatgagtatttttctgtgctgtagttattcattctcatagatatgtaacataattccttttgcaaaggtaaaaattgagctatctcttgttgaggatttgttgatctctgtctaaagtttcaaaaataagaactttaaaagcaaaatgtaaattcctttcaagttttagtaaaattacttcaaacttagtagcttaaacaatacagatttattatgttacagttctgtaagacagaaatctgacttgatcacaccatggtaaaaccaagatactgccagggttggttttttcttgggggggggtctgtgggaagagtttgtttcctttggttttccacagcccagaggctgcttgctcctttgatcactgtcccttcctccatttttaaaatgaggaatggagtcagggtgactatggttagcaatattgtattgtatatttcaaaatagctagaagagaggatttttgaattctctcaccgtaaagatatcaaagatgtatgaagtgaagaatatgttgaatatcctgattcaatatttaaactatacatacacgtgttgaaacatcacactgtatcccataaatatgtacaataattatgtgtcataaaacaagatttaaattgttttaaagggccagcaatggcagtttgtgagttcccatctcatcactctaacttcttctgcctccttccacttgtaaatgtccttctgattattttggtcccatcaggataatccagaataactttcctatcttaatatcaactgacgaacaaccttagtttagtctacaatttcaattttcctttgccatgcaactaacatattcacaaattctggggactagaatgtggacacccgttgtattagtttgtcctcacactgctaataaagacacagctgagactgggtaatttataaaagaaagaggtttaactgacttatagttccacatggctggtgagccctcaaaatcatggtggaaagcgaatgagaagcaatgttgcatcccacgtggtggcaggcaagagagcttgtgcaggagaactcccgtttataaacccagcagatctcgtgaaacttatttactaccacaagaacagcatgggataaaccttccccatgattaaattctctctacctgaccccattcttcacatggaattattacaattcaaggtgagatttgggtggggatacagccaaatcacatcatttgtggagagctgtgattctgcctaccacaagtaagatgtacaaagcatggaaggagctacagccagaaacaattataccattgggaatttctagcagaataaatagcagttattaactgataagttaatagattaagtaaacctaaataattgccttcattagcagcgaggcttttgatggtccatgtatcacagatatttaaacacaaatacatttttctcatttattccaataacaaagtgttttttggtttgttttgttttgtttttgaaagtttggtatgagagagaaagagatgagctgatttgactactccaggctagaggatatgtagctgagagtctatggctgagtggaggaaaaaaaaaaatcacaagccctgtccaggataacagagagagaaagctgtttctgttgagatttgatggcccccatcacaccaaatttgggcttctagctagcctcagttcttcagataactgaccttccttctttcctccctcttgtaatagtctttgtgtattagaagtaccttgaaatgctgggtcagaaaatgtggcacgaaagagaaaagctggctcactccacatcttgacctgatcatttcctgaacatgattgaggtggatgactctttgctcctctttggctgacctgcaggaataacattgggaataagcaaatctcctttggactccagagggtggtggtcaggaagtgggccattgagaacctaggtggaaatgcaggccagattattggagtagtttgctttataatgttaaaatatttatacacatgttatgtgggcctctatttccactcttatcttagagcccacacgtattatggagggtctagcagtgtttgtggagtttttggtactatacctttttcaagataaagtaaaaaacatttatggataatttaattgttccctatgtagattccagtgccaaattcctctcttagacactgtttctagtataacatgttaatatgtgacccctgtttcacttacagatttttagagatctatcccaggttacttaattcaactccaagacatacttttcttttaaatgcagggaataaagggtcagttacttagttactccggttttatttaatcctactgtcatctgacaatatggtactgatactatttcctatttctagatggttgctagaaatatactgtaatatttattcttgatatatgtttgttactttaacgggaatacataggctataaatagtccccttgcctctcacaagttagacagtcctgcccagaatgccctgctgaagagttgtagcagatcaccctgttcctccttaacctctctgttccgcatatgctcacctgtaaaatagtgatcatagtaacacccatcttgtgatgatgtagagaggtttaaagaagcaaattaggggaggccaggcatggtggcttatgcctgtaattccagcactttgggagtccaatcacttgaaatcaggagttcgagaccagcctggccaacatggtgaaacccacttctactaaagcaaacaaacaaacaaacaaaaaacacaaaaattaactgggcattgtggcagttgcttctaatcccagctacttggttggctgaggcaggagaatccgctggacccaggaggcggaggttgcagtgagccgaggtcacaccactgcactccagcttgggtaacagagcaaggttttgtctcaaaaaaaaaaaaaaaaaagaaagaaaccaattagggtggaaacacttagagcagggtgttcataagttgtcaccctcttgaagcaattgttggacactattttaaaaatgttttacttctgagtgaaatgttgcattttattttactggaagattcttatgtagtttaagtacattttacggtattgtcaaagagcatgagcaaaatatttaggaaagatgagaccatatttcttttatttatgacattgccacaaaaaatcaggtagatgaatttgtattaagtttttgtaccaatttcatatctaaaatttcaaagaattttattgcaacaaactctttcttaccattaactcaaaaaaattctgttttaaattgacttcattccataagtctctacactactaatttggccagaagttattttcaatcctaattgggaacaacaaagatccacatgatatcctttcaatttatgatgttgaagaaagttgaattgtaataatttgagtgtgcagtcaaagcaattttcaatactatgtatcactgtagaaacaagggagaatgtcttggttaactatttaagtggcttgagtatggcaattaaaatttcatctaagctcattttgatgaatcttgaaggtgacatttatttcttatgctctgaacatcgtaagttctgttgatttttatgggaagttttcaaggtcattttcagagatctatgacaaaatgacattatttgagaaaaaaaagaagaaatagctcgaagtttaaagcattatggtattccctaagcccaaaattttctccctttacaaaaacaaatgaaaggcaaaatagacaaacaaagaaaccatcaaaaataccttgaatcactgttggtgggaatgaaaattagttcgaccattgtggaagacagtgtggagattcctcatggatctagaatcagaaatcccatgacccagtagtcacattacttggtatatacccaaaggaatataaatcattctattatgaagacacatgcacacatatgtttattgcagcagctatactacttattatagcaaagacatggaaccaacccaaatgcccatcagtgatagactagataaagaaaatgtggtacatatacaccatggaatactatgcagccatctaaagaactagatcatatcctttgtaggaacatggaaaccaccatcctcatcaaactaacacaggaacagaaacccaaacacctcatgttctcactcataagtgagagttgatcaacgagaacacattgacacagggaggggaacaacacacagtggggcctgttggggcgtggggggaaaggggagggagagcatcaggactgatatctaatgcatgcagcttaaaacctagatgatggtttgataggggcagcaaaccaccatggcacatgtatacctatgtaacaaacctgcaaattctgcatatgtatcccagaaattaaagtaaaataaaataaaataataaaaacaacaacaaaatgtaccttgaatctccaaaataagttaagacaaatagttaaaattgagcatgcttttattagaagaagaaaatgtcattgacaatataacagataatttatagatgggaacatacgtaaaaacgtataagtacttagatctgctagataaagtgagtcccaaatgataaggttacaaaaataatgtttttttgtagaatatgtgttttcaatgagaaagtgttgcaaaagtcagtcatacagattggtaacttttatgtttatttttcaaaagcagctcaaaatagttctttagattctgtaacaccacggtgtcctaattttgctcctaaaattttgtcacaaaagtttaaattcacttgcaaattgatcttcatttaatcttcctctaggtgtgtaagctaaatcagagatctgcatgaactgcttattactctttcatgctatacattctccctaggtaattttgatcactgcaatcttttccatcatcatttctacttgaagactaactaatataggtagaacaaatttcaacttctagacctatatgctttccagatatctcaaataaaagataaaatttggggagatataccatgttcatgattttgaaatagtcaagactgtgtgatattgtcctcaagaaagactaaatagatcaacagaacagaatagaaaatacaaaaacagatttatacatatagttaaaatctttttttttaaatagcaagtcaattcatcagggaaagtatcagctttgaagaaatggaagagttttcaaagcaagaaatgtaaaacagttgggtatttataagcaatagaaaaacaaatttgattcatagcttgcaaaatatataaacattaataaaaagccaacctgaatgtattgaaatcttagatataaacataagataaatctttgtgaccttagttgaaacaaataagtgctgtatatgacattaaacatttaatatgtaaaataaaatattaacttgaacttcttcaaaagtgaaaatttttactctttttaaaaaattattatactttaagttcagaatgtgcagaatgtgtaggtttgttacataggtatatacatgccatggtggtttgctgcacccttcaacccatcatctattttaggtatttctcctaatgctatccctccccaagccccccaccccctgacaggccccagtgtgtgatgttcccttccctgtgtccatgtgttctaatttttcagctcccaattatgagtgagaacatgcggtgtttggttttctgttcctgtgttagtttgctgagaatgatcgtttccagctttatccatgtccctgcaaaggacatgaactcatccttttttatggctgcatagtgttccatagtgtatatgtgccacatttgctttatccagtctatgattgatgggcatttgtgttggttccaagtctttgctattgtgaacagtgctgcaataaacctacgtgtgcatgtgtctttatactagaatgattcataatcctttttctatttagtaatgggattgctgggtcaaacggtatttctagttctagatccttgaagaatcaccacactgtcttccacaatggttgaactaatttacactttcaccaacagtgtaaaagtgttcctatttctccacatcctctccagcatctgttgttttctgactttttaatgatcaccattctaaccagagtgagatggtatctcattgtggttttgatttgcatttccctaatgacgaatgatgatgagcttttttttcacatgttttttggccgcataaatgtcttcttttgagaagtgtctgttcatatcctttgaccacttttcgatggggttgtttgtattttttcttgcaaatttgtttaagttctttgtagattctggatattagccctttgtcagatggatagattgcaaaaattttctcccattctgtaggttgcctgttcactctgatgatagtttattttgctgtgcagaagctctttaatttaattagatcccattcatcaattttggcttttgttgccaatgcatttgatgttgtagtcatgaagtttttgtccatgcctatgtcctgaatggtattgcctaggtgttctgctaaggtttttatagttttaggtcttatgtttaaggcttcaatccatcttgggtgaatttttgtataagatgtaaggaagggatccagtttcagttttccactacccagttttcccaataccatttattaaatagggaatcctttccccattgcttgtttttgtcaggtttgtcaaagatcagatggctgtagatgtgtggctttatttcttaggcctctgttctgttctgttggtctacataactgttttggtaccagtaccatgctgttttggttactgtagccttgcagtatattttaaagtcaggtcgcatgatacttccagctttgttctttttgcttaggattgtcttggctatacaacctcttttttggttttgtatgaaatttaaagtaggtttttctaattctgtgaagaaagtcaatggtagtttgatggggatagcattgaatttataaattacttcagcagtatggacattttcatattgattcttcctatccatgagcatggaatagtttgccatttgtttgtgtcctctcctatttccttgaacagtggtttgtagttctccttgaggagatccttcacatcccttgtaagttgttttcctaggtattttattctctttgtagcaattgtgaataggagttcactcatgatttggctctctgtttgtctgttgttgttgtataggaatgcttgttatttttgcacattgattttgaatcctgagattttgctgaagttgcttatcagcttaaggagataagctgagacgatggggttttctaaatatacaatcttgtcatctgcaaacagagacaatttgacttcctctcttcctgtttgaatacgctttattgctttctcttgcctgattgccttggctagaactttcaatactatgcttaataggaatggaaaagggcatttaaaaataattttttaaaaactatgaactgagaaaacatttgaatagcatatatcttattggccaagaaaggtttatctcatcaggactaatgtttgtctttagaactggcacttggctggcttttggaagataacctgtgggcccttaatatattctgcctgttgacagtgtttctatacatctttggctttagagtacagtgcacaagtggttttcagcgtctgaggccttggaccatgctgtgctcatttgaacagataagcttatcctaacaatataatttagagtcaatggctatattttctctgacagatgctgtagtctgagtagctgaaatcactcatataggcaccaccttacatgactgatgcccagtaaaagccctggagaccaaaacttaaatgagcttctctgattgacaacacttcaatatgctgtcaaatattgttgctgggagaattacgtgtgttcttatgggattccactgggagaggacacctgaaagcttgtacctgatatcttctacatttctccccatgggctttttttctttgttgattttaatctgtatcttttcattgtagtaaactgtaactatgaatgtaatgtgttttctaagacctgtgaatcattatagttaatctttgagcctaagggtggtcataaggagccccaacacactaataaattactttcataaagaatatataaaagctgtcaaaaatcaaaaataaaacaaatcacccaattttttaaaaggcaaaagattgaaaaagacgtcatgatagaagacatggatgacaaataagtatatcaaaaaattttaacatctgtagtcattaaagaattgaaaaccacaaagaaatactactgatagttattacaatgtccaaagtgaaaaaaaatattgaccctaccaggtatatgcaacaaaatggaggaactgaaacgttaatatacttttgattgacaaccactttgtaaaatagatagattgacagcttcttaaaaaagtaaacctatgcttaccacttaatctagtcatttatcttctagatatttccccctcgaaaaatgaaaaagaaattgttgtatataaatattcataggcattttctctttaatagctaaaatgtggtcatgacccacatattcattaacaagtaattggtgatatatacgtacagcaaaattctgctcagcaatgaaaaggttcgactactgacacatgcaacaacatgaatgaatttcaaaagaattttgctgtaaagcaaaaatgccagccaaaaaatagtgcaccttatatgattccatttatataaaacttctggatgcaccaatatacaatatacagtaatatacaatactgaaagatggtcagcagttgtctagctaagatgcttattaggagagacaataattgcaaaaggggattattaaaagtagtcatgaggaaacattttgtggatttatatgttcactatcttgacaataatgatgatctcacggatgtataaatatgtcagagcatatctaataatttatcttacatatttttggcttttaatatgttaattatagctcaataaatttcttaaaaactcattggactctatctgtaatgtgtgtatgtttagttttaagtagagtgcagctaaatttttctccaccattacaattttcaaacatactttcacttacagaatagcatactgaaaattaacacatgcttttataattataaataaaatagtaatatatcatttctgctgaaataaatgcaaaccaattacaaggaatttattagtttttattttagttacttcatatatattagcatctaagcctcaaagattcactatgtaattgtgtaaattagtagtagggttacctgaatctggcttaatagtgaattaatcagtatttatctttaaacattttttcctttatgaattgtgtcacacttttaaagagcccttcctacattacaagcatgtataaaatatattcttatactattttagaataatttcagaagttagattgttttctagatttagtgttttcattgataccaaatttatttttatgtacataaatgtatgattttaagttagattatttcaaactggtatccctgcaattatctgaacaaaaattttttttttttttttttttttttttttgagacggagtctcgctctgtcgcccaggccagactgcggactgcagtggcgcaatctcggctcactgcaagctccgcttcccaggttcacgccattctcctgcctcagcctcccgagtagctgggactacaggcgcccgccactgcgcccggctaattttttgtatatttagtagagacggggtttcaccttgttagccaggatggtctcgatctcctgacctcatgatccacccgcctcggcctcccaaagtgctgggattacaggcgtgagcgaccgcgcccggcccaacaaaatttttaagtagtcacattgacttttttttcaaaagttagttttaagctatttgataacatatggatctacttcactaaagttgtatttttgtgtgtaattctttaatccatctggagatattttggttgtttttcgatcagatagccagttaaaccagaaagaaaaatcttaccaaaaagtttccacttagaaaatttaatagccaaaaaaactaatatatgcaagaatgaacaaaaacatattgataaaagttatacatcatatttttattgaaatatttcataatgaaatgtttcacatggttaaagaactacaaattcatccagtgtaaataaaaacttcatgggaaatgtataatatatgagggattatttgatatctgaaaaaactagatagaaaataaatgcttaaaaacttctagaaggtaatccagtagagtatttatcagcttaggctaacaaatgatataaacatgattaaagaagagctaaacttgaataaaaatattaagttgatgacaagtgtaaaacaccattcttcaaaatatgcaattacaaataggaaagtgctaataggagaaaaaataagatgtttataatgcaaaaagtattaacattcaaaactgttgataatataaagaaagatattataaggaaaagtattccagtattagagtagcctaagtataaggcaatttgaagaaagaaaagaggaatcatgaataggtttatcaatcctgattccatctcaccagtgattagactggtaaataagaaaatgtgtgataataccaagggtaataaagatatatttcatttacatttacagtgctggtaaacatacactgtacaaccactttggagaaaacttggaagtacctaaaatgtgaaaatgcacagttgctcttgatccagcaagggtacctctgagtatatattgtggaaaaattctcacacatgcatacacagtgaaacatgtaagagtgcttatagcagcagtgttgggattttctttaaaccctagatttgacctatatatctatcagtagagaatcaaaatataattcaagctattgttatacagtgggatatagtacatcactgataattaatacaaattaatattacgaaccactcaagtttgaatcaaatattaggtcatggtataatgaaattataaaactatttagagttaaaaacaggcaaaaatgtcacatttattttagaattcataattgaatagtagaagaaagtaaaaatgcataggaatcatcaacatgaaacacaggaaaaataaatgaaacataggcaggtgattatctgcagagcaagaaagtagagtttattaaggagggcagtatgagaactatctaagatattttaggataagaagcggttttgtgaatttgaattcattaaataacgctttctattttgttttgttattcatcatttaacatttttttaaaaaatataaagaattctcataagtatttttaaactagaagacaaataagtggaatgaaacatctaaatgtcaaattttggtgtgtacttcctattaatttctaagcagggacacctggcaagcagaaataactctgaggacatgtgggattttgaatttttggacacctctgtaaagttatttggcaagcaataataatagctaccacttatttatcaagtgtttactaatgtactaagcattgccatatatggtttattacttctatcctatttagtattcaaatcaatatgatgtctatttttgttctgttttaaaaataaagaagctaacatgtccaagccacatatttagtaagtattggaactacatcaaaacaagaaagaaacatttcaatggtttatcctactgtctacttcctaaaggaaaattataaatttacagtaactgatccaaatacatttccagagttactttagctttcacagtgttggccagcacaatgtgttttttgtttgtttgtttgcttgcttccttgttttttaattgagaacattcccatagttgactatttcaatatttaattctccaatcttgtatttttggtttatcttgataaacatcaaataaggtggaggcagtttacactgaatagacttaagaagctgatcttcacaagaaagttcagatgcttcattttaccacaatttctccactgcttagttttattacacctagtccatatcatgcatttgggttacttgcctggctcatctatgacagaaaagaaggaaaggagaaaggaagcaaaagagaataaagaacctaaataaatgctattcatctattcagagctgtttcaaaaaattaagtgaatgttttcttcagtattctcagtcaaatcttgcttcatacttattataaataccctgaaggagtcataccaatgtgttctctgtaaatgccatgaacaacactttgtttttgtataacggttttcatgactattgtattaatagcacattcaataatatttcaataggtcaaaattatgtcatatgttttcttacaaatttttgtcattttttagaattaatgctacagcccagaaaataaatattattatgaaagcttgtttgtaaaaaatttcagtaattttatatctttttggtaagattagtggcttctattgtatatatttacaatggatatcaatgttgatattgagttatccaatctaatattcttaatagctccagcttgaactatgaatggtagatgactatgttctgtacgtataccaatatgagtatttttctatgttaaagattttactagaatccttaaataaaccataatcatctaatatgattttctgctggaatttatataatttattatcataaaaatatattgaattgctcagataaaaattttaacttctataaatcttaatatataaaaatatggtcttcttcaacaaattgacattgcaaattggtttagaatatccttaaataattatagttttattttcaaataagctacttttgcaaattgttatcatttttaacttaacttttgtgttttgttttttgtttgtatttatgtcttccccaaatgtcctctttttttatgcaaatgtagagaaggcagacacctagaattccatcctagaattaagacgtgacaataaactttgattttgtgagtgcattgtacgctgacctaatagaagatgaaaagtggaaaaatttgcacaatgagttcaagaactctgaggaaaagtattcaaacagtctagttaagaaaaccttattaagtggaaatttcataccaaacaaggctgcacagcttggaaaagccctgcacttaaaattaacttcagccggtgatgtgctgaggctcttgactcaagtacaggcacacgggctggctatgatttggagaaacatggtaagtcatatgaatgttagttgataactaattttattgttcatgtgcggaggacatagggtcaaatgtgccccaagaagacctcgagaaaatatatgtggctctggatacagacctcatgtgacaaaaggaagcaataaccaggaaagactgattctctctgcttatcatttagaacaatcaaaataagtttgaaatgaaaaaaactccaggggttttgaaattattaaactggcatgtacatactaaaagggagccaataaggaatttactactaatagggcatgggggaaagcagatccaaagttctaattaatgttttaaaatgatggtatccatttgccagttttaagataagtccatactgctgaaaattgctctatgtttcttaccacatttatctatgtcagcatttattttacttctaaatttaattacaatttttaaattccattatacaagttatctcacatttaactatttgttacctttccttctcatcttacaatattacttctctacctgtcaaactatatacagtccagttcctattccaattatggctataattgcagtacaattaatcaattaattaacaaagcatagcaaaaaatcaaaagaactttaaaaaattatgtataattgtgatcaatgtggatgtttttaaatatgttcaactatttatactattttccttctcaaagaatcatcagaatgctgaacacataaaataaacattggataaattaaaaataatttttcattctaaacaatctaaagtaatttaagtatagttcctatttagacttaaccataacactttgaaaaacttgaaagaattcactgattttttataaaatttaaaattaatacatattacacaatttgtaatatagatttttactttgaacatgagggcattttaaatggagcttctttaaaatataattcacatataaaaatttcagaaaattttaaggacctttttctttttactaatgctttgattaggatttcagtctgcatacaaatttgtcaagattttagctgatactctttcaggaaactattttaatagatcattacctttccttatctctcaatgtcattagatatgtacattttaatcttaatttctaggacaaatatacatatctttttctgattatgtgcctctaagtttgataaaaagttcttgatgcaaccagtggactcaacacttctccttactttgcatttataataataggcttatagcagtttttttctccaaattaaagtataaatatttaatttttacttttaatttttaaatgttactcaatagtatgtttataaaatgacttctggaaaaacatgtctattttctatcatttattatgtcataattgagagaagcaaggacccaaattcatttaattataacacataaaactgaataaatatagatgacagatatgtgttctttgtttttacatatctgttgtaaaccatattactcagattatctcacttctttcaacttttctaataaaagcaattaccatacctatgtggaatgtattttaatagtaattcattttaataaaagttatatatttttaggaggtcaaaatagcaatttcaatttatgaaatgttgactttttaatcttattgacatattttctggaggcaaattgtagaactatttgaatagcaacagaaatttccagtggagagacagtcagatacgaaacttccgtgagaaaactgtatttatcagtgactgaaaatccttggattaggacctaactcccacctacttgttcttgtagatactctgtctaaatacagatatagatagatacagatacagatacagatacagatatagacatagatacaagtacagttacatagaaaaataatattataagatatcctgaaatatatataatatgttagtttctaacattgttttaaaagttagttgtttaaccaatcaaagcagaaacaacttaaacagactttacaaaaattcatcagatttaataaagttgtctattcgaagatagggacttctttcttttttaaaaattaaatgagaaagcaactattggcaaattcaaattcctttcttatcaaaacacgtattttgaatttttattgtttaaaacaatatagaatttgaattaatagctatcttagtaaggaaatatctttcctcaagactgcaatgtgctatcttgcatacaaaattaccaaataaacacagtgactgctgataaatttttacctaattatttaatatggttcccttgaaaaatgaatgattaaatgaattaaacaacagttaaacaattagattcagtatgaatattatgtgcatactgtacatacttttgtattttcaaggtcaatcattgcatagaaagaaattaatttttttaagaagttaaaaatatagtacttaatcttgaataaatttgttaataactagggcacattaaaatatgcctcaaacgtagtaaaattacattttaacatttatacaagaggttgtctagaatatcacaaaagaaaaataacctaaaaataaaaactttcccaaaacaaagactcaaaagcagcccaaaactgttacaacaataaaaataatgccacaatatttgtttctattttaattgaaaaaaggaaaagcagatttagttattactctaaatagatactttattgttgatttttctagatttaatagattcaatagtttgaacttaaaaccgtatttctcaattttactctaattttctaacctcaaacttaaaacacatcatttccctctttattttcccaccaaccacacacactagccatgtcattctatttgtatttacctcattctttttcacatactctttgtgtgtgattctgctttaccatcttttagaatatcttttctcaatttttcacctatatcaaatattgttttaatatatagcatattaatagaaaagctaaggtatagtaaggcaaacagatcggaagacaattgccattgaaaagatactcacaatttccaagagaagggagcatgtcacgccaggggagactacagggaagaactcaggtccatcaggaaacagagagagggaggaattcacgagcaagaccctagactgtggtgtttgcaggaagaaaccaagcagggtaaacaagcttaggaccggctcgtttgaataatttcagtgggctctggggcataagagctgtccctggttctctggtttttggccctagcgtgattaggacagaagcacagtggcctggagtgtgacagccctatagagtatttgtttgggaattggttagtttgtatttgtaaagcccatcttcgtgaggagttcaggggagacttcgtagccagaagctgaggcaaggtgactccagcatactatccatcttcaagaacaagatgtgtctgaattgctgtatgttataaagtttcgatgtctaatagagcaaatctttcatcctgttggttctctttgatttaatttgcttttttttctctctaagtactgttctcggaataagccaatctgatatgtgtgtcactattccaatgaatgagtagatcacactttatttttctgcttcttgtgaacattaattagttcagttttctgaaattttcaatgctattgtgattttttaaaattaacaatgctactttgcttattgtgtacttgtcaccagaaatgcaagagctaagatgtctctggaaatggaattcctgggtcacagggttggcacatgatcaacattattagataatgttaaattgttgtacaatgtaatcacattaatttgtatgccaatagtagtatataaaagtttgaattgccctacatccaaactcacacaaaaataaatgcagtctaaaaaaaaaattataatgtgatgtatatgaaattatattttgggctgggcacagtggttcgtgcctgtaatcccaacactttgggaggccaaggtgggcggatcaacagaggtgaggagttcaagaccagcctggccaacatggggaaaccccgtctctactaaaaatacaaaaattagctgggcctggtggtgcgtgcctgtaatcccagctacttgagaggctgaggcaggagaatagcttgaatccaggaggtggatgttgcaatgagctgagatcatgccactgcactccagcctgagtgacagagtgagactccctctcaaaaaaaaaaaaaaaaaaagaaattgtattttgttgttttatagttttaatttgaattaataataagctttggtaccatttcatatattttaacttttttattatttaaaaactctgcttaggtattttcctattttaatttttatgtctttttctaaatccttaacataaattaattgtatcatgaattttaatagattgttatgtacttgcaaatgttgccatgctgtttatgatgatttttcattttaccaatggtgatttagaaggaacagatactcttgatatgagtgggaccaaacttacaaatcatcttgctccagtcagtttttgtgctggtttgaaaatttttttcatactctgagattcaggctaaattgcttttaaaattttaaagctttgtgtttcaaatttatattcttgatgagatgtatagagtgagaatgagatacattgtctttttattataaacaatcttgctttagtagctactgaagtttacttttgaaattgtatttcttaaatatttccgttaattatagaaaattgattttgtattctattttatatccattaactttgctcatttagtaattctaataatcctaggcattcttcacaatgcattgtaagataatgtatacatttcataggatgacaatttttaggtacacttaatggtatgggactatagattattgggattttctttggtttaaaattggcaaactatttttaaggggaagttgttaacaatcactttctacaatatgtgactctctcttcaaagagtaaatcagagacaaatcttttttttcaaatttctttttttgaaaatcaataataatgaccctattttttagtttgaatggattctcattaatttaaaatgcaaatattttggactaaatgtttgtgtccctcccaccccaaatttaaattttgaagccctaatccccagtattatggttttggagatgtgggcctttggaggtcaaaaggttgagatgaaaccatgaggatggagtcctcatgatggaattagtgaatttattataaaagacacagaagagcactttcttgtacacttcctttgtctctgtctctctgtgtgtttctctatctctcttccctttgggaacacaacaaaaggtatctgtgtgacaagcatgaagaataccctcagcagaaactgactatgtgtatgctgatcgtgtacttcttagcctccaaactatgcggaaaacattttgttgtataagacaccaagtttattgcattttattacggcagcctgagcagtctaacaagaaagcaataaaaagtataagtaattaagatgaaactaaatttatcatccaaattctcaccataaagaaataaccattttcaaaataggtagaacaagattttacatattttcctaaagtttatagacagagataattgataaagattttatacaaactgactattaagaaatgattgtatttaattataacagaagataaaaataattttgtatagagaaactgattaacgtttatgcatatttgttcctaaagtacattcaaagttaagagaacagattataaaatcataacttagagttcttatagtataggtttcttacaagaagggaagaaagcaaaataaatttaacacaactaaagcagatcttgcagaatgtgattcatatatggacatgagtcagcttcctaaacttgaatctcagtgttatatagatgaacccactcagacagaaacaacattgaactagaacagaactcctttgacaggcaatgcacatgtttttaggagagcagactgtaagctttctctgagcctcagagaggcagaaggtaagaatgattctggggtatgcatcctcaagtttttgtttaaactctctgaataagtacctcataccattttgccggggcaaagtgagtggatggggaaagcaggccaagggcattatgtgaatgggtcacttcaaagggaaaaacatatctgaaacatggtagaagcaccccataactaactactttttcatgcctttggcctattggacttaaccattatagcaatgatgactcaaaaactacattaaagcagtgttaagaggaacattgacggtgctaaatgcattcatcagggggacaaaaaggtctcaagttaatgacctaacatagcaactaggggaattagaaaaaaagcaacagaaaagacccaaccccaaagctagtagaagaaaaaaaataactgaagtcagagaactgaaaaaaaattgttatctaaaagtccacacaaaagatgaagccaagagttttttttaataaacaatactgatagatcattagctagattagcaaagaaaaagagaagatccaaataagtataatcagaaattataaagattatattaaaattgatcccatgaaaatacaaaagatatgcagagactattatgagcacctctctgcacacaaatctagaggaaatgaataaattcctggaaacacacaatctcccaagactgaatcaggaagaaagtgaaaacctgaacggaccaataggaagtttggaaatggaattagtaataaaaacctacgaaaaaaaataaaataaaagccccgtaacaggtggattcacagctgagttctatcagaggggcaagggagaaatgataccaatcctactgaaatgtctccaaaaaatcaaggaggaggggcttctatctaactcatactacaaagccagcattaccctgttaccaaatctggcatagaccacggaaaaagaaaagagaaaactacagatcaatatctctgatgaaaatacaagcaaaaattgtcaaaccaaatccagcagcacatcaaaaagttcattcactatgaccaagtagggtttattcctgggatataaagttgattcaacatatgcaaattgataaatgtgattcaccacataaacagaatcaaaaacaaaaaacataggatcatctcaatagatacagaacaagccatcaataaaattcaacattccagccaggcgcgggggctcacgcctgtaatcccagcacttcgggaggccgagacgggcggatcatgaggtcaggagatcgagaccacggtgaaaccccgtctctactaaaaatacaaaaaattagccgggcatggtggcgggcgcctgtagtcccagctactttggaggctgaggcaggagaatggcgtgaacccgggaggtggagcttgcagtgagctgagatctcgccactgcgctccagcctgggcaacagagtgagactccatctcaaaaataaataaataaataaataaatgaaattcaacgttccttttatgataaaaaccctcaacagattaggcattgaaggaacatacctcaaaataataaaactatctatgacaaacccacagtcgccatcaaactgaacagcaaaagctggaaccacacccctggagaactgagacacgacacggatgcccacttttaccacttctattcagcatagcactgaaagtcctagtgagagcaaacaggcaagagaaagaaacaaaagccatccaaataggaaaagaaattaaacaatctctctttgccaatgctgtgattctacacatagaaaaccctaaagtttccatcagaaggctctttgaactgacaagtgaattcagtaaagtttcaagaaataaaaacattgtaggaaaataagtagcatttttatgaaccaaaatcattgcagctaataaccaaatcaagaacacaatccaatttacaatagccacaaagaaaatgaaatacctaggaattcatccaaccaagggggtcaaagaccactacaaggagaagtacaagacactgttgaaagaaatcagagatgacacataaatggaaaaatatccatgctcatggattggaagaatcaatattgttaaaatggatatactgcctaaagcaatttacagattcaatgctattcctatcaaaataccaatgtcattttttaagtaattagaatgaaacctattataaaattcatctggaaccacaaaagagcttgaatagccaaagcaatcctaagcaaaaagaaaagccagaggtatcacattgccagacttcaaactgtactataaggctacagtgatcaaaacagcgtggtactgatacaaaaacagacacacagaccagtggaagagaatacagcacccagaactaaatttgcccacttacaactatgtgacctttgaagaagctgacaaaaacaagcaatggaaaaaaaatccctattcaataaattgtgctgtggtaactggctagccatatacagaagattgaaattggacccctgcctcttaacatagatgaaaattaactcaagatagattaaagatttacgagtaagacctaaaactataataatactagaagaaaatctaagaagtaccctttttgatataggctttggcaaatggatgactgagttcccgaaagcacttgcaacaaaaacaaaaattgacaggtgggatctaattaaactaaagagcttctgcctaccaaaggaaactatcaacagagtaaacagacaacttaaagaatgggagaaaatatttgcaaagtatgcttctcattaaggtctaatatccagcatctgtaaggaatttaaacaaatctacaagcaaaaaatccaaaaaatccacctaaaaaatgggcaaaggacatgaacagacatttctcaaaaggtgtcgtaacaagcagacaagaaacattaaaaattgctaaacttcactaatcatcacataaattcaaatgcaaaaaccacaatgaaataccgtctcacaccagtcagaatggcaattattaaaacttacaaaaaacaacagatgttgagaagtctgtggagaaatgggaacgcttatacattgtaggtgggaatggaaactagttcagccactgtggagagaagttttgagattcttcaaacaacttaaaatagaactaccatttgacccagcaatcccactattgagtatatatacccaagggaaaataatttattttatctaagagacacatgcacccgtatgttcattgcagcactattcacaataccaaagcaatagaattaacctaggtgtccatcaatagagaattgggtaaagaaaatatggtatgtatacatcacaaaaaacaatgcagccataaaaatgaacaaagtcatgttctttgtggcaacatgaatggagctggagaccattatcctaagtgacctaatagaagaacagaaagccacataccacatcttctcacttatagatggtagctaaacattgaatacacatgttaagatgggaacaatagacattggggaccactagattggggaggaaaggtaggggttgtgggctgaagaactacctgttgggtactgtgttactgcctgggtggtaggatcactgggactccaagcctcagcatcacacaattactcatgtaacagtctttcattaacctataataaaagttgaaattaattaaaaaaacaaaacaactacactgtttcattgctctagatttctttttgtctccatttaattatggagagacttgcagagacagaaatgactgtcacgtgttcttatacacataaagccctagaaacaggagccacagcacatcatgcactggggccatatggggaagtaccagagtcagtgaaggcaaaaggagcaagactaaagcatgagccagagcctttaatatggttttccttggaaggaatgagtgagacagtgtaagcagctgagcaggtttaagactgggtagtgtgagtactttttgtgtaatttagtccctagtgttccagcacctgattctggggtgacgaaagcagagggataatgtcccagaccacaggagccatataataagagtcaagtgagggtgtggattctggattggttggtttgcatataaataacatgatcataggcaagttgtttagtatttctagaaattagctaaccctaggaggagcactctgtcttgaaacccatatggtctcaagatgtcaaagcaaaacaaaaacaataaccatgattaatacagcaagatggaataagctatatattgccttaaggaagaagttacttggctctctatggctgatcgtcataacctgaaagatttgttctcttgacttgagctggacaactggggttttatttctgaagcattttataggaactactcattgttcttgtttttgtcatagtagtcatgatgctggccaattgcattcaactcagtcttaacttcctttttatagcagccctctcaccagaagatcgcccttactacaaaactgcaaaaagttcaagaacatctcataatatggttgacaatagagacaactaaacagtctctaagtcgtgaagatttgaatctctaaacttccctgaattggcttggtcaatgcctcacaagctagttaatgacaaaatgggaggaggggtagccagaccatatataagaatagagttctgacccacatctttgtagcaaccagcctgggaagccaaaccacagcctctgcatcaaccagccccaaatgaataggatttagttaatgattgccaggttccctatttttgcccccgctgccaactcaggacccatcagagaaagtcaagtatgctttctgactgatcacataagatgctccatttccccttatttatttagtccatcttcagcttccccatacaaccttaaggcagagcatatccaaaagctttccttttccaggtacaaaactttcctattcctcagcctttctttgagtctctgcaaaacatatatgatgacagctgactttcttgttataaaaagtctgaataaatatagattctctctgttattattaggtgttatttatttccacaatctacaaaaaatcttcaggcagggtactatttaaaggtgcaatattgaaaaattccacataaaatcaggaaaaaagaaataatgttcatctcactactgttcttctacacattactgtaagcactaaccattataaaaagaagaaaaataaagggcataatgatcgaataggaaaaacaaaattgtctttacttgaaaatgagatgattatggaaaaaaacctaaggaatacatttcaaaagctactagaactaaataatatatatatatatatatatgaaatttatagcaaacaaggttaatatatgaaagtgcatgttgagtgttccttatccagatatctgaaatctgaaatgctctaaaagctgaaactttttgagagctgacgtgatgctcaaggaaatgttcacttaagaattacagattttggatttctggattagcactactgaatttgtaagtataatgtaaatattctgaaatctgaaaataatttgaaatctgaaatacctctggtcccaagcattttttaactcactatatgtgctcatttttttttaacaaatacctattaagcagacactatgaacaaaaactgtgcaaacattggaaatacataagtaagcaaggcagaagggcctcttgtattaaaaataaacgaaggaggacactagttaaagtggtaaggacagattttaatcagtaataatgattgcaacagggaaaagagtgcagcatgagttgaattcaacttcaatttgtatattggcaactgattgttttattttattttagattctaggggtacatctgaacgtttgtcacatgggtatactgtgtgatgctgaatattggacttctaatgatctcatcacctatgtagtgaacataagacccaatagatagtttttcaacagttggccagctccctctctcttcccttttggaatctccagtgtttatggttcccatctttgtgtttttgggtaccaaatgtttacctcctacttataagtgaaaacgtggtatttagtttgctgtttttgcattaattcgacaagcattttggataagcagttcttaaccggtaaaatgtgttgttgcatactaataatgaatcattaaaacataataataaattctattcacaatagaataatcacaagcatataattcttaggaataaaggcaacaaaatatgcgtaggtcttttatctagaagctaaaaaatattattgagaaattttaagaaaaaatagaaaacgtagatctatacatgttcttattgatatgttatttatattaagatatccatccaccttatattgatctacaaatgtatttcaactctgatgaaaatcacatcagattttactgcaaaataaaaataaacaatgtgatgtcaagatgtatataaatatgcagaaagacaaaggaacataggtaacttaaccaatcttggaaaagaatataatcaaagaagtaacattaaattattttaagatttttaaagctgcatgttaaaaaatggagcatccataaatatgtttatgtttaacatagatgatgaactgattttctatgaagacaaaggacaatagaaaacacatatttttacaacatatctgaaacaactagataaatttatgaaaatcaaattaatttttttatttctaactttttctgttgcccaggctggagtggtgcaatcatagctcactgcagcctcgaactcctgggctcaagaaatcctccttcttcagtctcctaatgcactggggttacaaatgtgagtcatcatgcttagcctaacgtcaatgtttatcccatatcatttacaaatttgcgatgaatccaatttgagatgctcataaacataaatatgaaacataaatataaaaactaatactataaagcatataagagaacaatcttgcatcttagggggcaaaatattacatctttagggaggcaaaaatatttcagacaaaacaaacagaaaatgtagccataaaggaaaaaattatataaatagggcttcctcaaaataagattttctactcatcaagagaaagcattgaaaaaaattaaaaggcaggacacagaatcagaggaattatttttaatacatacaaatgacttagaagatcttaataagtagtactattcagtaataaaatgtctaacagcctctccccaaataggcatgggtcttgaatatcttacaaaggaagatatgcaatgtcacatgaacaggcactggacatcattattcattaggaatatgcaaatatacatgacaatgacagccattgcacattcactagaaattatttaaagaaattttaaaatactgacaataccaaaaattatagatatgtagcaactggaagtctttttgtttcttaagagtgtaaaatggggcaaacactccagagaacagttaattattttcttataaagtttaaaatatatttttctttgacccagtaagttttttctctgttacgtatacaaaagaaataataactgatgccacgataaagatttattcaaaacttattagaacagttttattcttaaaactaaaccttgaaacgacccaaacaaccttcaataaaggaatggatacacgaattgtatatattcatacagtggacactacagtactcagaattaacaacaacaacaacaaatcagatattgacgtgtaacaaaatgtctgggcctctataaaatattatattgaatgaaataaaaaagttgaatatctattcttactatgttgaacaaattaaaaaaaattacatggcataaagttccatttatatgacattccagaagaggcaaaactaatccatggttatgaaaataagaatggattaaagatttgatgtgtgagtgagatttaagtggaaaggcatgaaggaatttttgaggtgaggaaaatgcctgtagcttgaatcggtattgattatatgggtctttgtatttgtccaaagttattgaattgtaaactttagatctgtgcatttcacagtttaaaaaaatttacctcaccagtgaaactctgtctacctaaagtctgcagaaagcataactcaagaatttaacataaggtcccctaatcacatgaaggtaagaaacagccatcttttaaacatttaaaaagtcaggggaataaaaaatccagtttttttttttttgaataactattaaacttatgccagtgaaagaaaataaaattaattttcacaaaagttgatacacatgactgaggattaaatctatattgatattgttgagattaaaatacaacgcaattttaataaacatttaaaacacggacatggtgtccctaacaatttgttgataggggagaggataatataaaaattaattttatgaatcccacataagtacttgttaaaaacatatgcctctgttctttttatttaggaatcactcacagaaagcacacattctttgcttctgcactaactctggaattcaatattagaaggctcaactgccatgaatataaatcaaattcatctgcatcccctatatcagactaaatgtgtttgtttctcagtattctgctatattccttgtattaattttaatagaatcaaaactgagatatggaagaggatgttatatattgaacatcttttcttccatctagcatacccaatatttgctgcatgggccagaaatatgagaattagaaatgcgtctttatttggggtccttacttcattcacaattctagatagtcttctagttatgacaaagtctaagaattttatttttaaataaattattatcatatttttctgttaccattttttggttggttttccatgcagtttgtgcctacttccaggaggaagacacctacacacatttactcttctctgctttctttacaaatttgaatatgaaaaagagagccaggaattgccaaaagctggttactccaagaccctaggcattctgtcaaaatctaacttggatgatcatgtaaaatacttatcattttattaatatcagtatgttcattcaaatggtaacaagattttcacttgatttctaaatcactgatcttaagtgaaaaatatcaaaatagaggacttcacaaatattatcatttagaacatcctcactttaaacaacctaaagttatttttaatgttgaatcaatcatactctgaccttctccataggaaaggaaaatgtaaatatcccagacagcagagagcaaactgtcataaaaataaaactgtactttcaaatagctgtagtccacagcacagctctaacccaaattgtcatttcaactgcttcacattattagaaaatacttaccttctagctttgaacatgaaagaaaagtactcttagtctatcagtttccctaactaggagattcatgtatttgttggggtcatataaagaaactgatagtgcaatttaataaggataatgcagagaggatttggagactctttgcaaagctgttgaagggatgagaaagaacacaagagactgcagtaacctttggttagagtgatttttatcacccctagtttgaaagggccagtggcaaagcaagtttactaactttaggataaagtagactcatcaggaaaagagcaaccacctaagcttaagggacaaagccaatcacccctgggaagccagtgttaaaaatacttgatcttgctctctgctttcctgagaatacaaatcattcactttaactcattgaattcactcagcagtcagaagaaaaggaagcctcttgttggaattcatactaagaagatcagaaagtgtagtggaaaagagaggactagaactgcaggtgcaagtagaagtcagtgtccaaaaagaagtgtatttgtattgttcatttgacctcatttattttagtatgcaagcgtatgcttaaaaatatttcagccttctttttactatatatgcaattcgtcattatttattaagagattatatattcatcattacttcaatgatctcatttttagctttcctcttctttattaatggatgcagtaacttctggcattcccctgagaatattaattctacttatttggaagtactctttttattgctctctgctgtctttcttttgtattttatacatctttcatttgctttatgttattttaatcttaccctatgcacttacaatgatggcacttctccgaatgactgttgattttcttcctttctttctttttttcatgttgtctacatttttttttcaaggtgagtttctgctagactgttattactgagcaatcctttggtggagaaggaggttcatgctgctacaggccacaatttgcctcatttgcagtcagatcaggctttttttttttttttttttattatactctaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatataccccttcctgtgtccatgtgatctcattgttcaattcccacctatgagtgagaatatgcggtgtttggttttttgttctatcgcaagatcaggctttttgtcagagagaggacatgcccattaggcaagatgtattcagatatttccaactgatcgctgccttttctttctgattcaaattcccattctcaatatatttacctaatgtatgcctccattttgcctttttaagcaagactaaaaaatcaatacccttggaaaaaattgattaatttggctaacttaaatttaaagtcttcacttctagcaaaatagttttactacatattttttactatgagaaaatatgtaaactatgtatacgaaagcaaatctataaataatttagaaaaataaaaatatttcaatagaaaagtgggaaaatgtaaaaataggtacttactggaagaatcaagagattagttctaaagaccttaattatttatttaaactaatttaattaaaattttaaaaataattaaatttttcaataatcaagtaaaacaaattaaacttaaacaatagaaccttttattttgagatgcaaaagcatgaatcaaagacatctgtaaagcttaaatgtattcagattgtaaagctaacccatgtaaaccaaactaggccaggaattagactatattagcgccccagactcccccaagtgtcccttcctaaaagaagctcctctcaccctaagttttatgtataatttttttgctgtgcttcaaaaaggtatagcatgtatgcatctctgaacaacataccttagtgttttttggcctgctttgataattactatgaaatcctctttctgtattattttgtgccacactccttttgttcaacatatgtttatgagtgacagccctgttgttgcaagcagttgtaatttattttttttcactgctctataatatttgattgtttatatagatgagaattttctattttattccttatatacatttgtgttattttaaagtttggttgcttaggagcaaagtcaatatgaaaatacttggacatatgctctcagaattatatgcataagtttatctacaacatataactatccaaggaattttaggagcaaacatatgtggttacttatttaatcacagactaactttttttcaaatcagttgtatcaatttatacttcttcctgtggtacctaagatttcataaaattatactttcaatccatgggcttagcaaaataattcaaagtttaataatatcaaattgacatctgtaatttaagaccactttagatgaaaatttttgatatctattaaattttacaatgtgaataacttataagcacaattttccttaactcatcatctgtcttatgaaatactaacatatgtgcagtaaaatgcaataggatgtcaattacagctttttaaaaatagtcaaaagcccattaaatagattaaatgtccaccaatagagaaatggctaagtaaatatgacatatctaagagttaaagaaatgataaagattaacgtgtgttgaatcactaagatttccaatacatattaaattgaaaaataaaaacacattattgtggttacaaatacacaaagtattagattatcaaatcagactcacatgcatcggagatcttatgcaaacttaactaataattttatggataaaaattattgtgaggtacaggtggagcaaggtaaggtcagatagcactgtgagaatccctgggtcctttccttccacatcagatatgctttgaacaaggataatagatgatgattctgagtaagatgtgcggtcatctcacttacacagaggagatatttagatcacaaaatatctcattttgtctttagatggtccaggaaactacgccccatgagtcaaagagatttaggttttattataaacaaccctagaaaagaaatcacagcacatacattcttctaaaagcattctgtaggtaaggtattccttcctggaaacttcttagtttgtttgccaagaggttagccagttatatggttaccaaaaaacctgccttctttgtctcctgcatgtttcttattaaagagaatgaatgaattgcagaactattgtttgcacatttacttttaaatggtttatcagtaaaatatgtgagaatacatttttaaaataaacttatgtgattgctttggaaaatgtctggaaatacgcaaaccacactgataataatggccttctggggatgaaccaacacacaatagatttactggtaatcgtttgattttttcaaaagtactacgttcctgtataatttgcatgattaaaatgtatttaatataatttccacctgtgataattttcttgtgtataaataggacattgctcttgctattagcagctatatactgtaatatttatagttgaaccacagggtttagcagacttcagcccatacactgaacctgtcctattgcctgtttttgtacaacctgcagctaagaatgtttttatattttttgaataatacaaaaatatcaacagaataatagttcgtaaaacaaaattaacaaaatttaacatttgtgtctatgaataaagttgataatattgtaaccacagccatttgtttgcatattgtctactttcttgttacaacagggtttagcagttgtgacagagacttctacaatgtttccaaagcctaaaatatttactgtcttaccctttatagaaataaatactttgctgacactgtgactcataataatgtttgcaactactttttgaataagctcaaaagtttacagacacacactcctaaaatatttgttatattgctctttatagaaataatttgcttatccctgtgaattatagtgatgtatacaactgatttttgaataagttaaaaaatttagctggggcggtggctcacacctgtaatcccagcactttgggaggctgaggcgggcagatcacctgaggtcgggagttcaagaccagcctgaccaatgtggagaaacccagtctctactaaaaatacaaaattagctgggtgtggtggcgcatgcctgtaatctcagctactcgggaggctgaggcaggagaatcacttgaacctgggaggcggaggttacagtgagccgagattgcaccattgcactccagcctgggcaacaagagcgaaactcagtctcaaaaaaaaaaaaactttacacacacacacacaaacatggattatggattgagttgcatgtatttgaatattagttttgttattcttgcaacttattaggaggtttgacactttttctaaattacaattgggtgaaatttttgcaattgataaattgctagataacataatctagctcatattatatgataactttagatgttaaatcagcaataaaccttatgaagatctatgtttctaggaaataattacttcaacaagaagggaaagtaaagacagaaggtaaaacaaaatataagacgaaataaaataaagatgggaattgaatgccatagaagtgtggaagttggagggaaagtttctaaaattatttggataaaaaggaagccatatattttactgaatcttctagatgggttttaattctgtatcctttcatactcacatactatgccatttttttcaacttttcattccacttgcacttcctaacttatgatgaatttacctatatagagtccttttatcatttagactaaaattgtatttatttgaaggtaagaacggtcatatacttcttagttgttttcagaattgaaaacatggttgaggccaggcacggtgtctctcatctgtaatcctagcactttgagaggccgaggcggggggactacgagatcaggagttcaataccagcctgaccaacatggagaaacgcggtctctactaaaattacaaaattagctgggcatggtagtgcacacctgtaatcccagctatttgggaggctgagtaaggagaatcgcttgaaccctggaggcagaggttgcagtgagccgagatcacgccattgcactccagcctaggcaacaagagcaaaactcatctcaaaagaaaaaaaaaaaagaaaaaagaaaacatggttgaaagtcaatatccatgtgataaattgagttagaaagccaatgagagcttagctaatataaaggtgatggaattcactatcaaaacttttcagagacttagaaaaaatatggaaaattagtgaaaatgtaagagaatgaagctcgaaatcaagataattaaactgcaaactttaagaaggcaggaaagatatcctttacttagtttgtcttgtccaactaatggttagttgaatgccatgcacataacacatccctctgagtacttattgaataaatgtagaatgtcattctggaataaattgaggcaagaaactagagggatagcagtgtgaaaagtgagattaatttatttggtatagagtcagtaaatttaagtgggtcatttgaaacaacaagcttaaaagaaaaccaaataagcattttcaatgcatagaaatgcaaccatttttctccttctgtactttatccattcaaacattgcttgaaaaaaaatataactttcagtcttgcttttttatctccaccaaactcagataattttggtcgttgatgacctttctaagctaattcctattttagaatgctatggacgaatgaatctcaaaacttcttttaaccaatttattttattccatttcctaaggaatagaaactttttacctccaacccaggggagctatgaaacaaactccccatttatttccaatccaaacacatttgataaaacaggcagaggaattttttatcagatctgtattttaaattttcatgactgttgttcaagagtttccattcttgctcataaatatgtagaggcttaaaattcttttctgaaaaataaactgctactttaaatgattttaactcatttttataatactttttttattctctgatgatctcttgctgtttttctttctctagaaatgttctaagaataaattagctgatatagtaagaaaggttcacaaaatgagtccttcacttatacagcacctcttctaaataacagagagattacaaatccaatgtatttaaactctgagttgtctatatgtgtagtgttataaaatgtagctgtcagttttaacagcttttccccctgagatttcagtggctagctaatgatcttttttaagaattaggacattttctagatagcgaaatggcaggaaaacatatcaaatacatatttttccattatagtattctgaggactgtaaagtcttactcaatgtatatcacttttaatttttaggatacatagaaatatttgctagtagaaataaatggcaagtgtttacttgaagatggtttagaaagatgcttttctcttttaatttgaattgctactgtaaatgtcatcacatgtatttcagtattgtctatgccaactttgtacctgaaaaacagtattatgaattaggcattatattccatcttcataaattaaaaaagaaacataataactagcgaagtggaatgaggaaggtgtggggagacacagaaattttcaaaagtagtaacaaattcaagcatgtattagcttaatatatcataacttaaatgatttaaattaggtatatgtttataccaataagttttaaattcttaattcttacctcatcaagtaccaacaaagaatgcccttccatattaatacactttgggaattaagataaagtatatgtaattaaatcatcaaactccttttgttgtttagcaggtagtttgatataataagagaaattgtgttctcattatatatttgtcacaatgaatgaatgtaaaaccttaatcaggctatctgacttcttttagtgacatttccctttttgcaaccaacacatcaaattagtaatatttatcctacaaaaataatgtgaagataaatgagataagatatataatagtcacaaatacttattgaataaagctgtttttatttatatatttctatgtacttactagatatgttcttattaaatattttattatggtatatgtcaagtcttttactttttttatacttagtgtattatagaactcaccatccaataaaattgtaatacaattttcttgatttactaatcctaggtgaaaaaaaaaaatatatatatatatatatgttgttttctgtttgaattatgcttagttgatggcattttcaataatctctctgattcttccttttcctgtttaaactactctcattctcattgtggcctagagttctttttccctaatattgccttcagaaggctaagtttctaatataataacaatttgagtctttaccacttctctctagaatcgtgatttagactaggttattagagtaaacaatatgattccaaattttgtcctttttttaatgggctagcatccaaaaagcataagaattctggggggaaatgacataattaagctagattattttaatttaaattcagaattaaaaatgattttcaatagcttctttgtcttaatttaataagcttttgttgaacattgattatattttgaattctattttttcttttgtttttagttggcacataattatacatatttatgggatacagagtgatattttgatacatgtatacaatatgaaatattctaatcagagtaattagcatactatcaccttgtacatttgtcatttccttgtgatgtgaatattcagaattctatctggtaggtttttaaaaaaattcactgaattattgttaacttaattcaccctacagtgctacagaacgctagagctattcctcccttctagctacaactttgttacaaagttaactttgcttaccaacctctttccatcctcttcttattcccatcctttccagcctctgataattacaattctacttgttacttttataagctcatttttagctcccacatataagtgagaacatgtggtttttctctctctgtgcctgtcttatttcacttaacataatgtcctccaggctcatctacgttgtaactaataacatgatttcaattcactacaaaagttaaaaggatactcaacagtgccaaacattctattttagtttcccaatgcattcactcccacagcattcataacaataaccttctacaaagttaccacatgtcttatgctaaattgatgagatctcccaatattaagtaaattctgtcccttagctctccctctcattttagtattatcattctcattaatgaataattccctttttgttaaaagtttacattgacctaccgttgtccttcagttatcaacttactttgtattctttctttgaaagaaatcaatcaaacaatagacagtctccttcaatatttcctgtactgtcttcaatccacttagctgagtactttcttttttctctacttactcactttttcccctgagtgttctcaagcattttcatgagtttaaaggccagttacatgatagcatctcagaatatttccaattttggtatcttctctgagttagagctttgcatagtcatctacttacttaatatcaaatgtggattgttttatagacaactgaaattcataatgttttaagtagagttttgttattttctctgcttcccagtttgtgtgtgtatgcttgtttgtttacttcagctggtgttcccattgattttatcttatctaatacaccaaaaccctatcagtggctcttttcttcaaacttgcacatatcttaaatatgtatttcattattttgaacaaggtctccaccttcttgtcgtttcactttaatagttttctaattcatttccttgtgtttattcttgtccctgtaaaaattattcttggtttaagaggcagagatatatatgtattataaacacagggaaacaaattagatataaaccaattactataaaccaatgtaataataataatatatattacttttttctatttttttatttcttctttttcttttttattttttgtaatgtaagcaagattctttccctcctctgccttaaatcctttagttacttgtggagtacaattacaaatctccaggatgctaaagctctgctctgctgtctacaaccacaggcaccattcaagaccctcactcctaatgagacagggctctttccactcttgaaacacagtttttccccatggcagggttttgcacaaggtaacatcttgtctttgaagcttcatagtttggctttttaatcaaatggttccttttccatatttaagtcatcactttacatttcattttctttttttttttttttttttttttttttttgagacggagtctcgctctgtcacccaggctggagtgcagtggcgcaatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccttacatttcattttcttggagaggtcttcacatgactccaagctatcaccagttatgtgctatcgtagaacatggtttatccagaaatagtgataactttaatcactattgatcattctttggttttctttacatttattttatatcttaaacactgtaatataaaagacctcagggatggaccatgaatttcatatttagcacaatacttcagaagatccatcctatcctttttcttttttattcattttattttaaaattttcattttgaactactttaaagcttacaaaaatatattttaaaaaatcaagaattcctatatattcttcacccagcttcttgactgctaacaccatatctaagagtacagttactcacattaggaaattgatacggaattagttacttacctacagaccttatttacatattttgttcatggttccactaatgttttttaactaggatcaaaatcagggtcacatattgcatttatctgctacatttctttagttttctttattcgggtgcggaggctcatgcctgtaatcccagcactttgggaggccgaggcgggcggatcatgaggacaggagatggagaccatcctagctaaaacggtgaaaccccgtctctactaaaaatacaaaaaattagctggcgtggtggcgggcacctgtagtcccagctacttgggaggctgaggcaggaaaatggcgtgaacccaggaggcggagctttcagtgagcagagatcacgcctctgcactccagccttggcaacagtgcaagactccatctcaaaaaaaaaaaagttaaaaaagaaaattcagcttttctttttgtctttcatgcccttgatacttgttttttgtagattattttgaagtttgatttttttctaatatttcttcatggttaaattcacataatatattttggcaagaatgccacaatgccgaggttgtccttctcagtgcatcatatcaggaggcacatgatattatcgtgtcctaatattgttgacgttaactctgatcacttgaataagacattgtctgccacatttctccacttcaaagttaccatttttaaaatcagtattttgttgagagatacttggagattatgtaaatatcttgtttctcataattgtatccactaattttagcagacttgtctgcaacaattatgtggtatttgccaagaaatgagaatctatttccactattctttctatatttattgattagaattctactgtatggaaaagctttcctttgtcccacttttcttatttatccaattatttatttatattagtgtggattcatgtgtatttggtttaattaatctgaataatctattgccatcattatttattcccttgttcaatttatctcagtttgggtcactgagagccacttctagttagctcctatgttctttggcatgtctcaatcattagttgagacttccttattttcttaacaacaacagatgtctcagacccattttgttctttctgccgcatgcacctagaatcaggcattgatccaaggagctctgtatccttttaaagaagaaaaaagtgaatccaagatttgaatgctagatgtgctgattgctattaaaatgttattgcttctagtcttagtggttaaaattaagaaatatacacacattcggccgggcgctatggctcacacctgtaatcccagcactttggaaggctgagatgggcggattatgaggtcagaagatcaagaccatcctggctaacacggtgaaaccccgtctctattaaaaatacaaaaaaattagctgggcgtggtggcaggtgcctgtagtcccagctacttgggagactgaggcaggagaatggcatgaatccaggaggcagagcttgcagtgagccgacattgggccactgcactccaagctgggcgacagagaaagacttcatctcaaaaataaaaatatatatatatatacacattcacacacaaacatgtgcgtctaggtctatttatatatctacacattcttttcaatttctatctaacgtagaaaaaaagtaaacttaagtatatattgatagttttgattctgattgaacaccataagtgttattctagtctccactccccctcatttctaaattctttttctaaaacggaatcagttttgttttagttaatatacttaatataattatttgctttttattttttttttaaatttcaacttttagatttgaggatatatgtgagtgtttgttacagagtatactgcatgatgctgaggtttgggtatgactgaacccatcatccaggtagtgagcatagaacccaagaggtattttctatggcactttacacattctagaaaactggttgttaattagcacaagcacctataatagtgcctgatatatttagtactcaaaatatatgttaaattaaaaacaaatgtataaattaatggttgaatatcataataattactcaaaatgtaacataattccaaaggagaaaacttttttctaaaaaggctctctcaattgctctttctgatttactattttccccaatctgtagttgcttcattattgtttggaattttgcattagttgtcaataaacaaaaaatatggatcatatcacagctctttcattgctttcatttcttgagatatatgaatgtatgtgatatctttgatgtcctgtattttatctttattgctttttgttacttaagaacatctagaaaagaagataaatattaatcatgtcagaaattatcaaaggttgattacaataaaaatttctctaatgtgataaccactcaaaacttccttcttcatcaaaacacagtattttttaaaaaatggagtgctgcatttttatttcacagaaaataatcaaatgatagccagaatattttgaactagagtcacataggatattctaataatactgcttgtgaaagaagtattgaggaggtcttaggaccaaagaatatttgtttaatagtgtcagaattcattttaacaccataaaaaggatatgtatttgttcaattttcactcactgcacaaagaattagataaaagaagattttcagtaatagcattcattttgagtcttaccaatcctttcagttttggtataacaaaaatgctattagcttttactctgttgtgttgaattttgatgatttctgacagtcttcactgagatgctcaaagagatgagacttgccagtcgaaaaacttaagatctcattaaatttaccagcaacataaaagctatttctgcctcttaactttttgatgtgttgcctttttctagtcctcttctcaggacctatttaaaagacaataaaaattttgtttttgtgtgttgaaagatttctccattatcaagagagtagtccttaactttagaatgactgcatatatagatatgaaaaataaggaaacaattattaagaaaactaatcgaattttttactaatatttagtaattttaacaaaattattgtgcattgtattttgtagcatttatgcagaggatatactaacctgtttaaatttttagacaaaaatagtagaaaatagaacatcgtcattttcaggagcaaggaagtaacctgtgaaaaagtgaatgcctttcttcaaataatatgctaatgaaaggctgagatattaatgtctaaatattataaaactttcattttaatataatgttttactttatatttatattatattgtataacaaagaaatgtgagtcttgttacacctgagaacttgaactggcaatctacatattgttgttgaaacaattttaagttaaacatacaatgagagggaaaaatgattctgttgcctcaattttaaaaggaatattttgaagaaccaattttccatataatagcttgttatgatcttgccttttagcctccctggataaagaaatgcatacttataataattgaaggaagacaattttccttgttttctgcaaattagaaatatattaggctattaaatacataattcaaaatatacagaataaaggtattatagaacctaagaattatataaagaattatatacataaagtaatgaatacatatacaaatagtataaaaatactaaaaatagtatttgcttattgattaattactatgggtattatataactcttagtttctacattgcttttctattcttagttattataataggtatattataattactaatatgtataaactacttatagtttatatgaatgtgttatatgtacatgtatattataataactaatacctataaactatttacaattatatgtattataataactaataaatataaactacttattgtcaaaactgtttttaactattaaaagataaagcacacagatatgttttctttactaggtattcccagaagcactcataaaactcggggttttcatatagcagtgattacagacttgatatttttattattcccattttatagattaagagcacaagacccatattagtgttatttagccatgtcatagagccaattcccagatattttttccacttgttttgtcatgaagaatgagaagtagaatcagcatcaagtttgtgctaaacaagtacaataataagaagcacagcaaatgctgactagactgtaagaatatttttgcttttaggccacccgaaaaagataagatatatgaggtgatcaaagtgaataattatataaacaagaggaattagaatatgaataagccaggaaaaataggaataggccaagaaaacacacacacccatttcttatttaaacctaaagggagacaaattcattcaatctatacatatttattttgctacctcaatagagataaatatcttctctaagaaaaatcccactttacttaatatgtatcacatttacctaataaataacacattactaaaacagagagcaaccagtgttttactcttttttttttcagagatgttttgctcttgttgcccaagttggagtgcaatggcatgatcccaactcactgcaacctccacctcccaggttcaagcaattctcctgcctcagcctgccaagcagctgggcttacaggcatgcaccaacatgcctggctaatttttgtggttttttttagtagacacgggatttcaccatgtcggtcaggctagtctcgaacacctgacctcaagtgatccacccgcctcggcctcccaaagtgctgggattataggcatgagcctttgcgcctgacctcatttattttcatataaaatatagggtcaagtatgttgagatattagttacgttatattttgctcagtattgcctgagagttggattattttatcattgtagagaatagcttctagattatgagaatattaaataaaataaactggagagactctcagcagcaaactatggtatgtaagtacatatgtaaatatgtatctatctatctatctatctaatctatcctatctatctatctatcatctatctatccatctatctatctatctccttttctttcatttatgtctggatctgtaccaaacaccaggcagaggagttaggagaagtaactgaaaaacccatgggtgacatcaccaactaaaacaggtgacaaataatcagcatgaaacccagaatacaagagtaattgtcctaatcactggcagcatagggccagtaccagctggagttaatggcaaagataaaatgaagataaaaggaagtattgtaagatcttaatatcaataaactacaacaagaaatcatcaataatgctcactcgcaaaagaaaaatacttaccctgaagaaaaacaattggaacaaaatcaaaattaatcagagaatcagataatctgagacaagtaagataatttttagaaaataatttttagaaaaaaataatttgaaggtacataaaatcaaatagaagtggtacaaactatagtaagagatatagagtataaaaataagagtaaaaaacagaaattgagagattaaaaacatctaaaaattttctaaacataaaacttaggcaaagaatagtaatacccgtgtaatggttatttctaagaacaaaaattaaaataaaaaataatattaattatttgagcatgaaggtaaaaggataagaagtttatattgataatagacttcttgatagcaatattttatacaggatgataatcaagaaatggtttaatgattatgaaacagataacacagtagcgagatgagattttattcatccaaactatgaatcatgtctaaggaatgtagaacatcatgaatatttatgattttaaaaaacattgttcctgtgatggcttttttagaaatgtcctacctactgacaagaagacaaacatcatgtgaagcttctggataaggactaaatatgtttaattttataattaagagcaagtaatggggattaaagtgacaaaacatgatgctattaagtgtgttaaacatgaagaaataatgcaactcaacaacaaacagaaaaaaggagaagaaaaagaaagtagacgaatcttaatgactatctcgggagtatctaactgccattaaaaaatatggaattaaagtaaataaatgttaagccaaaagagagaagaaaggaaagagagtttactagagaacagtattactactcattgaagaaaacaatagatagtattcaaacacactagaggactagtatattttattataatattattataagataataataagaataaacatagaaacatttataaataccagatgagtatatcctgcgcctcaaattaaagtgtaaatacagggcaagattttatataaattatttatatagcaaaaacttatataacagaacttaacaccagcataacaggtatatcaaagacacaaatgggcttaactcaccattaaatggcgtacttttagattggctaatggagcagaatccaatctattctgtgtgcaagaaacatattgaacaaggcaattcagaatggtttaatgtaaaaggaagagcaaagatagatcttgtatgatagcaagatcctgaaatagttgtcagaattttgctatgagacaagatagaatttaagacaaaataaatttaacaggataaggaagggaaatttattctacagaaggattcatgcttcattctacattaaaaataaaatatatattaataacatacacaaaattacaattttcataaagcagaaataacagaagttgaaggaagaaatagacattacaactggagattttaacatagcttattaattggtaagtccttgaagaatgcaaataagcctcacttttagtaattaaaaaaaattaacacaaatactgacaaagactctctccttcatcaaactttagtcagatttttgagctctcctctcaactagatcttcatctaggccccttgcctagtctccatagctcacttttaacaagaatccttaagtccatatagagagaatcttgatatctgatcaccctgagctgccttcagcaagaatcctgttaatttggtttagcaagagttcccctacttttgacgtctcctcttaataattttccatccactgaccccttcacactgctcctttgctacaaatttccatgtgtgcttgtatttggaattgagctcatttctctactaaagtctcttttcctgttttgcagtaatttctgaataaaatcttctttactgctttaattatcctctggctctggttctccttgacattactctttgaagaatcactttaggggaaaagaataaatgcaaaaagacaaagtcagagactattatccgaatatagaatggagataatgatatcatactgaatgggcaaaaactggaagcattccctttgaaaacaggcacaagacagggatgccctctctcaccactcatattcaacatagcgttggaagttctggccagggtaattaggcaggggaaggaaataaagggtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtacaaaaatcacaagcattcttatacaccaataacagacagacagagagccaaatcatgagtgaactcccgttcacaattgcttcaaagagaataaaatacccaggaatccaacttacaagggatgtgaaggacctcttcaaggagaactacaaaccactgctcaatgaaataaaagaggatacaaacaaatggaagaacattccatgctcatgggtaggaagaatcaatatcgtgaaaatggccatactacccaaggtaatttacagattcaatgccatccccatcaagctaccaatgactttcttcacacaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagatatatagatcaatggaacagaacagagccctcagaaataacgccgcatatctacaactatctgatctttgacaaacctgagaaaaacaagcattggggaaaggattccctatttaataaatggtactgggaaaactggctagccatatgtagagagctgaaactggatctcttctttacaccttatacaaaaattaaatcaagatggattaaagacttaaacgttagacctaaaaccataaaaaccgtagaagaaaacctaggcattaccattcaggacataggcatgggcaaggacttcatgtgtaaaacaccaaaagcaatggcaacaaaatccaaaattgacaaatgggatctaattaaactaaggagcttctgcacagcaaaagaaactaccatcagagtgaacaggcaacctacagaatgggagaaaattttcgcaacctactcatctgtcaaagggccaatatccagaatctacagtgaactcaaacaaatttacaagaaaaaaacaaacaaccccatcaaaaagtgggcaaaggatatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagccaggaaacaacaggtgctggagaggatgtggagaaatagggacacttttacactgctggtgggactgtcaactagttcaaccattgtggaagtcagtgtggcgattcctcagggatctagaactagaaataccatttgacccagccatcccattactgggtatatacccaaagaactataaatcatgctgctatgaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacgtggatgaaattggaaatcatcattctcagtaaactatcgcaagaacaaaaaaccaaacaccgcatattctcacttatacgtgggaattgaacaatgagaacacatggacacaggaaggggaacatcacactctggggactgttgtggggtggggggaggggggagggatagctttaggagatacacctaatgctaattgatgagttaatgggtgcagcacaccagcatggcacatgtatacatatgtaactaacctgtacattgtgcacatgtaccctaaaacttaaagtataataataataaaaaaaaaggaatggagataatgatgacgatgatgtcttggatagtgattgcaatggactgcatggctgttgccaccctgtctctgaaacttataggtggaaatcctaacccttaatatgatggtattaggaggtgggactttcaggaggtggttacatcatgaggttggagcccttctaaatggaactagttcccctatataatagacccaagagagttctctcactctctgacatgtgaggatacaagaagaaaatggtagtctgcaacttagaagagagatatcactgaaacctggtcactctggtaccatggtctcagacttctagcctttagaactgtgaaaaaattgatatttgttatttctaagccacctagtctataggtctttgtgatagcagtcagaattgactaaaacagtaatagtagcaatggcaatggaaagagtgaatgcatttgatatatactttgaagaaagaaataacaggactatcagtcatgtggacgtttggcatgagagaaatgcaagatggtagttaaacaaatttgtgtctaagtctgaaggttgaagaatagtcaaaggtaaaagtaaagctatgggagttaccgacacttatgagccttttaaaggaattatttatttttattgttaaatcaccaaggaagggttgaaacagacaatagaaattaatgccaaatgagctgaaaaaaaaatgtattgcaattgagttgggaataaaaagctgaggtggcaagaagaaaagcaaggttggcatatttttaacgaactctataatgaataatgttttgaagaggaagaaattttcaacaatttgaaatgctgctgagactttgggaaatgtgaatggtgcccatgtagaagttattgacagtcattgaaacaacactccctttagcattatgtataagaaactagattagaatgaaacaaatggattcttaattccagaattgtggagaaatagaaaatctaaaaacgtattggaaacacaagaaatgcaacatgaactataataaccatccatttcaataaaattagaggatttcaggttcagtccatgataaagtagcacaaactcacaccctgaagttggctagaaaagctgggcaaaatatgttagacaactgttggaagacaccggagaacaatcaatgtatacagagcttgagtgggatcattattaaaaagaaataattatagactataaattacattcactcagatgtttttcctctaataacatttcccaaatactgatgtgaagaaagaaagcatacacggaaagtgaaattttactgtgttgaggtgacagagattagagttcagagtatctagtgtgtatggggctcacgagacaaatttccaagaaggaggtaaccacagagagagagcctgaatatctgcatacaaatgccccttaagtgtggccagtatcaaagatatgtatgcacaaggtgagacgtcaagaagcctagcagaaatcaataaatgggaggttggagtgctgagtttagatttcagctagtggtttagagaagaaagaggctgtggttcaaacactggtaattatagaggatgagatgggagtgagaaactatatggctaaatgtggtcattcttcaggttttagtttttatgcagggtgctatatgctggttgcttctaacactgtaaaagttattatttaattacctacatataaaagatgaccatgaataggcataagatgaaagtatgtcattaatcaaaatgatgattaattcaattctctataattgtgattcaattaaaaagaatattattcatcacattcacagagtaaatgagaaaaatcacataatttcagtagatgcagatacataagatctgtatcctaacagatattgatacaaagaagtatttgataaaatttatcattaatttactgtatatctatatgctcttattaaactaggatttaaaaggcacttcattaagttgataaagtgtatcttttgaaatcctataaacaatatcttatgacataataatgtgggaatgttagaaggcttgcttttaaacctgggaacaagaagagattctctattattttcctatgctgctgtaacaaattgccacaaaatgggtagcttaaagcaacacagactttttctcttatagttctgaaggtcaaaaattcataaacagtatcagtggtctaaaaccaaggtgtgatcagcaccctattttttccagagaactcaggggagagtaattctagaaattattccagaaacgcagcttctagaactacatttcttgtctcaaaggccccttcttctatcttcaaagatagcagcgtataattttcaaatatttctccacttccatgatcacataacctagattctatgtcaaatctccctctccatcactcttataaggacacttaagattgcatttagagcccaccaagataattcatgataatcttccatcacaaaattcttcacttattcacatctgcaagtctctttgccataaaggttacatttacaggtactaaggattaagacctgacatctcttgaggccattattcagcctaacacagatgtcctctcttgctgcttgttttacacattgtacttttcttaatacttttgagaaagtttgctctaaagaagaaaaaaaagtagttctatatttgtgagacgtagactgaggagaatgactatttttctaatgtgatatataaaagcacatttatgtgacaatagcaataatagagaagataaatgaaagttatgcagaagggagaagatttgacaatagcaagcatgaaagtcctgcaggagaaaagtttggatgggatactgaataaaattgtaatattactttttgatgcatacgttcacaccattttttcacaatgcttcctagatttctctgtatttctttcccatctatatatatatatacacatatatgcatatatatatacacacacatatatatacacacatatatacacacatatatatatacacatatatacacatatatacacacatatatatacacacatatatatacacacacacatatatatacacacacatatatacacacatatatatatacacacactatatatatacacacacacacacatatatatatatatatacacacattttgactgaaaatgattgactgggatgaaagaaaatgagaaagaaaaacggaacaaggaattctcaattatataaatagaatattataattagtaaaccatgaataaaagaaggcatatgggctaggcgcggtggctcacgcctctaatcccagcactttgggaggccgaggtgggcggttatgaagtcaggagatcgagaccattctggctaacagggtgaaaccccgtctctactaaaaataggaaaaattagtcaggcgtggtgatgggcacctgtagtgccagctagtctggaggaggctgaggcaggagaatggcgtgaacccaggaggcagagcttgcagtgagccgagatcgcgccactgcactccagcctgggcgacagagtgagattccatctcagaaaaaagaaaaaaaaaaaaggaatacttgataaaaaaggtatccatatatcagatatgaagatgtaaaatttatgtgctatctacttctggaatttccaccataagggaataataatgatgtaggggttcacttgaaggacagaacttgtacttggttacttatgtacacaatctctgccttactcgcttttggtagatcgtattgtgtcatttcaatgtggccattattgtcttttatgaacatatacaacaaagtaatatacctttacataatgtctacatctctactgtaatttaaaatttaatggctcaaaaatgctaaattacaaaatagaggaagatgtgtgttaaatgcagattaatataatttaaataatattatatatgataagggtttgtaaaacttaaccattaagatggatagatgagaaagatagaaacctagaatacaatactagaaaatctagaaacatagtagagatgagttcaataattcgattctatataagaggtcatcaaactacaaagcacagagctaatcaggccactgatacattttggtaaacaaagttttattagaataaagtgacatccttttattttacatattgtttacggctacttatgcactacgatggcaaatattggtactcgtgacagagatcacatggcacgtacattctaaaatacttaatagttggcccttcacgaaaggttttgagagctactgctctaggaaatctcaggttcaatgtcagttatgaatcagcgttgcttagcatagccatgtttgaaatcctttccaatgacaataattgttactgcctctagacagaagagtccaattattttaaggtttcattattaggaatggttcatttaattaagccatagttgttacttcaagtataattaattagtgaagctatattgcttttatgggatataattaataggaaaataggttactgctctgtggcatagttataatttaaatgctgtggctttatagaatttaaaggtagggtctgtttattatgaattatgcctcccatcatctagctcatgtgaggtagttctggaatagcacattatttatgtttgctgataatttattttagatataatggttggttaggaaggagttcatggtgaagaaggtagatgtcacaaaaacatgcctgaaatggtgatggagaagatgaatccgtgtatttattcatttaataaattatgttgtcattcaagcaaatacaaatagtctttactctgaacattcatataaaatatctgttgtataattaatcgtgtgcttctgaataaaatggatgaaagcatagtttgcattataagcattaattcattaaaatttaccctgaacattgttatttggttttattagcaagaaatatagcacttggaatggtttactaaatacatgtgaagaactctagatcataaagaacctaaaatacagaattttcagcattattataatctatttaattacacattcaggtttatttgttactgaaacttagtaacttgattttgggagttttatatcgcttctgtgtcttgtttgtttgcacaagtttgtttatggtgaagtgcaaagtattttagtaaaagggatttgagccacagatgacaaataattacaggaacatataacataaactacacttggactttaaagcaggtttagattatattactttggttattattctttgttttcaaaagggaatgatgggttatagctatatgcctaaatatttaggcaaaacacgacaaaagaagggtgaagagaccttttatctaatggccaaagtagaaggtagcactcataaaatatactgttttgtgtaataagtgaatggaatctttacacaattttttgctagggttgtttaggaaacttttctaattggcaactacttcatagaaaaacttgatccagacctatatgtggaacttccctttatattaacttgctgaaattattaaagttaagagcttgtttttccaggttgatactctcaagacctacaaagaccagcacattgaagcaatcagttgattaccgtcgtgatgcctgcgtatgtttatttcatgtcagacacacctgaggtctgtaattgaatacataaagagtgcaaccatggaagaaacaaggttggcttgtggtgttcctatggcagcatcgacacagcttcaagtgcaccatgagcatgagcactgccaagaaaatatattggctctcaactctcagaatactgccgcgtctagaacttttggccttgccaaccactgggcagtaagagacagtaacaaatcacagcagatactgtttccttagagcaattaaattacatcagaaaaactaagctgagtgataacaaaacaatttctaaatgtcaggagcctgtatcaattcattcataagttgctcatttcacatgtccttggtgttgcttatgattctactcatgggtcattgtcacctttataccaggatctagaggacaaagcagccactccagaacattgaaagttactgtagtcaaggaaaaaaagaatgttgtgaggcacgctctgaatttttgcctctagaaggaaacagacactttagtctactaacatttcaataagcaaaaggaaatcacattccataactgaattaaacagggcagtgagctatatcctaccatgtgtatgaagaagccaaaaaatatgtaagcaatcctaatgtttatcaccttaaatttatccatgcatgccactgtggtcactttcactgtaaaagcagtcattgcagaatcatcactagtatctcagtgtattagtcagggcaattaatattagtttctgaaccaaactgcaaatatctgtgacttaacacaattttttttcttctcattcatataataattcagtagaggattaactttctgaaattccttaaaggttttcactgaatcccctgcatttaatataaagaggagtatgagaagcattgcgtgaggtatcttatagctcagtctaaaagtgggaaatataacttttacctacatttcattcaccagtgaaatggtctcatcctacctgcaattgaggctgaaaaatacagcatttccttgtggtccaaagaaggaaataatgttatctcaccaatctctgtcaaggtcagtccttctgatgccaaaatacctgctttaatcttcctcccattataaaacacactgacttctctcaaaatgaaaaatgcagagttctttcaaggtctggcatccagctcaaaatgtagtatctctggccactcataattctcccagtgaggtccagataaggtcctcatttctcagtaaaatctaaacttaaaagaataaatatgtgtcctgtgtacaaatatgcaacggtgaagtgggaacaaggtggcagcaataaatacatctctatcaccacagtcatttgttcttgactatttgcaaatcatttcaggaagacatggtgaaacatcctacactgtgagtggcagaaccccatgtgcactgcaatctcatttcctaccctccggaggagtatataaacttttcctacgtaaataatggccacatttttgtatcgatacattgtaagttctaagatgtgtgtgtttttttaagaggaattaaaatagaaaagcatatacctgaaagatgttcctcgggatatatctgcatatattctctactcttgtcattttaaataaaaatacagtggtcccttgatatcctcaaaagattgggtccaggaccccagaggataccaaagtcagcacatattcaagtaatcctgtggaaccagagtatacaaaaagtcagtcctccatatctgcgggtttttcatcctgtggctactgtattttgatccacatttcaatgcagatgctgatttttttaattaaaagaatctctatataaggggatgcacacagctcaagctcatgttgttcgtcaaccgtacttttttatttctgtccaatataatttaaataacataattctgtgaactgcatgtcattaattacatatactaagaggtggcataccaatgtgtttaaattccaagaaatggtggctagcaaatttaattctcatctctgctctgccacagacaagttctgaagtcttgagcaaatcatgagtatctgtctctagcttactcaccttaagaaggagccagtaagtagcaattatctttcagtgttcttatgaggagtaaataacctgtacacatcaatgcttagaacagagattgccatgtggtattatgtccagagttggttcctgcaggtgggtttggtgggttcgtggtcttgctgacttcaagaatggagtcacggacctttgccgtgttacagatcttaaagattgcatggacccaacgagtgagcggtagcaaggtttattgtgaagagcaaaaggacaaagcttccacagcatagaaggggacaccagcaggttgctgctgctggctggggtggccagcttttattcacgtattggcccctcccatgttccatttttgtcctaccagagtgccctttttttcaatcctccctgcaattggctacttttaggatcctgctgattggtgctttttacagagcgctgattggtgcattttacagagcgctgattggtgcattttacaaacctcttgctagacaaaaaggttctccaagtctccactccacctaggaagtccagctggcttcacctctcagtatgttctgaataaactgggctattaaatatgtgatataaattaatcaagcagagaaaaagttactagtgacagggaaaaggagaaaatatgtattcaatattattttgtaaacaatttataaatatgcttcacctatgagtttcttctcagtaccttagaaactataacaccatggaaaattttggatagtttagggaagtgcattatttggtaatgtgaaaaataagatggtcgtgataaagcaacttgggaaaaaagaaagggcatgaatcttgagaacacgtactttctgagaattttcatgtttagaaaagagcaagctaaaaatctggaagcgtgttttttcacaggcaattttcaattggcctcatgcatttctgtgcatcttgcaaatagaaaggcactagcttcacatttattacaggttttcctttttaaagatctttatatagtggatagccctggaagatcaagatattgtttatttatggatgagagaacagatttattttcaagtaaaatgaagatagtgtttcctccacagaaaacatcagacaagtgtgcttactgctcatttattaaagatttaagtttcctttacttggagttcttcatctgtgacacaaactgtgtgtagcatcaacttgaactccttgtcatcatctccagtaaacttgagggaaaacaggaaccagagcaaagatgaagctcgtgcaactctgtgctgtgctgcaaataatggaagtctttctgtctctgaccaaagagttatgtgtcttctgccagcatccataaaactgaagcaggctaacttgtaagctcagatccttcacagttcttgacaatagtcccttaaaactgtctgcagatgcacatcccttggaaaaattttgcatccttttaagaataattaatatcctagttaatgacaactatatgacaggatagatcactttaagcttctacccagattactataacttttaggtaaataatgtatatgccactttttctaaggttatctagccattttcgatgtagaaaacaatattgtgtaagataagctgagcgtatttttcacttcgtttttgttttgcaaaacaattttactggttttgttaatgccccaatcatcagtactgcttggtataagagccgagtttgaagaattatcatgttgcaaatgtattttgctcatttatttcaaattagtagacagaattgagaggtggaaaattttagaaaaatcttggttaatcatacttggaatttggttatgtaatatctctttctcttttggggaatacaaaggttcataaactagtgataatcttcactcttggaaccattagatgctatcatgaggttagcacagaagataaatttataatgttgcagtgaggtaaggaaataaaacatgtaagtctttgaaaacaacactatgagagaccttgcaggctaaaaattagacaccaaagcattttttgttacttttggagaataaaagaagtgtgcccctcaatgtcttgtgggagaaaatatatagtttgatacacttgtcaatatctctaactcaaaaatgatgagtataacgagtgacccttattgtagtcttatatttctctccaacaattaagagagttggtggggatgttttttccatgagttcatcctgggccccaggagattttcatcttgtattctctttataatcctatcttagtgtttcatcctcatggctaagttcagcaatacttcacagtaaaatgtgtaagaagagatgtaaaaacaatcggctttgtctttatggagattaacttaaatttatgctcataatataattcatattatacttgatcaaaattaatcactgataagagactatagaaggtaatctcctgcttgtggtcataagtacttaggattctattactaaacaaaatgaaagaatgcattatatggacaattagtggtctctagtacaaagaaattaccaggtcatttccaattctcaatattaaaaaaaagtttatttcttactgcactatcaaattggaaaggtcagtacaggggcattcaataacagtaaaaatatgaataacaatcatatgtataacaacagaatcatttaaaaagatgtatatttaaaatgtgattattgcattttatttcccctggcagaaaataataaactggagaaaaatcacatttgattgatgtctgttacatggatttttaaaatttgtatcaatgaatgctttttaaaggtaaactaattgaggcctaccaaagataaataaatcttaattattttggtaaatatattttacagtttcattctttttcaacttaagttagataatatgtactatattctctcctaatataaatgtttatgagcattgaaactccatctggagaaaatagaaacacttttaatttaaatgacgtttgaagaaggaaatgtataaatgtattcaaaactgtaagtgaaaatgggaaggtcctattaaaaaaaaaagaaaggataaacagtttccaatgacttttctataatattagcaaatttattatgatctgttatgaaagactgttttgccttccttgtttctactgtctcaactccctaagtactaattcaattgaaaagttacttcaggtatgggtccattttaatgtccctctacaagatctgcagtgccattaattataatcatataatcttagagccaaaagggcccttagagattatctaatcctattctattaatgcatgatgaaatgggcttagcaatctgtctaaggttacacaaattcaaaaacacatagaaagttttcataatcaaattaaattaaaagtacaaaacaatgtcactaatttatgtataagaaaatattaaatatcattttatatgaagtgattctgataattttaatgagttcataacaatgcttctaaatatttcaaaattttagtttatcatccaaatataataatatacacttttataagtgagtcttctacagtgaaaattactaattataggaaagagaaaatcatagataaatagggttgtatcaaactcttaaaatgtacatgtggaaatttaaaaatatcctcttgacaaggggatgttgatgtcattccataacaggattgacatgtgtaattaaaacaaacaacaaaaattaagaatatataaataatatttaaatgcttgaatttgttatttataatgaatattgaaatttatttagtgagataaaaggttaacaaattcttgaatataattatactacttttataataaaatgcatccaagctgaaatctcacttctgttgtcaactgctttgatggttctagactcatttccctatttttggtgagtcataagatggatgacacacatgctcaatagcaggttattttcatggctaaggtttatcatagcaaaaactacagagcaaaaccagttctactcatatttttaatgaataataagctaatgatatcttgttattcctatgctttgtctatcatacctacacataaatataagcactggtaagttctggttccaaacatagcttatatatgaatgccataatcattcaacatgcatacattagccttgaattttgaagattaaaaagtgtttgtaaaactacctagaaaaaatttattatgattacagccactattagatttcaaaagggttcatcagaaatctctgaggtatatgatggggaaagaatattttgactaccactttaacaggtctgctatttaataatattagtttctttttaattgatgtttcatggacatccagaatactagctataaaatcatatatgctgcataatgcaagcaaaacaaaagcacctgtaaatattacagaagactatacatgtatgtatatcattgccataaaatacctatatacatatacgtatatacacacataattgttttcacaaccatgatagtattacttacaaaagcatgcaaatttagggagatggctaaataagttatggctttttcataaattgtaagcctattcattataaaatattattgaggatcaactttcatttgttccccaacaaattattgagcatctactatgcatattctaggcccatttgtagggactggggaaaaaatagtgaaaataacattcagaatgtcttggcttcacagagctgttgttccagtgttgggagaaaaacagtaattaataccacaaagtatcatgtgttgtatgccagatggtttaagttctattctaaaaaatgtggcaaagaaggggaatagagagttctgggcacaagaggtgctggatactgaacaagatggttgccgaaagcctcactgggtggtatcatctgaatacaatgagtggttatgagagaatgagccaagagcataattgagagaacatattttcagggagcagaaatagcaaatgaggccttggtgtatgaacgcacccgtgaggttccactaaggatgccaatgtgatacagcagaggagatgagatcacactccatggggagatggtcacataaagcttcttagaaaatggtaagaacttttgtttatttaattggcagccatgaagtattttaaacagaaaagcaatcgcctctttaaagaattagcagtaacagtttgactgatctgtgaaaatagaccatagcatagcaaaagagaaaacagggaaattagtgaggaaactatcgtgtaaactattcctgaagctgttgtaaactataaactatgtaaattataaattgaaattgttctatgcaaacaagatatatttgaaccctgtatattagaggcaaaagtccataatattggcaatgttttggcctgaactatgggaggaacagagttggaattactcacctgggtttaaatttgggaggagcaaatttgggattagaggataggaaagatcaatagttttatttttaacaggcttaattttaaatagacacttaatcatataatatattttaaataaattattaatcataaaataatgtcaggctaattctaatactcacctatcaattataaatatattctgttttttaaataataaatcttattaattttataattatcaaagatgctataaaaagaaatattttttattactatgctactgatgtatttccattgcattgactaacaaaattaatactagaattttcaaaagtatccacagtggttactttatttgcactgttaattcagctctttttaagtataccttctagttccctaattgatataattcagagactacacttggacacaatttaatgaataagcaaattaggtccagttattccaatatgaaattccttttaattatgggctacttttggagatgtagaataatttgaatgtttaatttggtgattcagtatgacctacttcacattgttttatgagtgggtgaaaaatataagtgctaggaaatgtgtaccagaaataatttgtcatctaattacatttcagaacattatacctcctcaaaactttgtttcagcatatatctcattttaaaaatctatgttgtatatatgtttacttctttaaaattttaaaaatgtttgtggcattcacataaaatacagaagagaatagcaataagtgacatacatatacttcaggacctgaacatttatatgactacatttttttctttccttaaaaagaatatattcaaatacatcatgagaaaaatgtatagctttatagttaggataaacctttaattcaagtgctgttacttgaattaaggatgcacaagccccggactctactccacaaaccccacctgctattctcaccacataaatacctagggagagggatctgtctgaaggaacctttcccacaacagcctttattcaaaatgacacacctgccactttcctgatgcctactcttgtactccaactgcagagtgatttattacacacagtttgcttgtatgttatataacagtgattacatcaaggatttgggtactagctaactgaattgatatatttgaaagtactttataaaacagaaagtgctgaacaaccattaagtatacagaatgatttggcaacaatcatatgtagtaccatattttctgaaatatctatttcttaaaaaacaagtttcattaagtgtattatttgctgaataatctctcaaaagtcatgttttcatatagctactattattgcattttgaaatcaaacattattttctttgccatttcagagaagcccttggtaatccagcccgcaaatgcaattcatgcgcatggctctaaagagaaatgggcaaacaaaaagaagtttaactacacattcaataatcatttatttattttcttagagatatctacagtagctctctcttatccttattttaataaatgctgacgtatagaattagtgagatttttggtaataatatttttttttgaggcagagtcttgctctgccaaccaggttgaagtgcagtggtacaatctccactccctgcaacctccacctcctgggtttaagcgattctcctgcttcagcctcctgagtagctgacaggtgcgcaccaccacgacctggctaattttttgcatttttagtagagatggagtttcaccatgttggccaggctggtctcactcctgacctcaagtgatctgcctgcctcggcctcccagagtgctgggattacaggcatgagccaccgcgcccacccgggttataaatttgttattcctcctgtggttgtttggatgtgtatttgtgtgtgtgtgcacatatacatattattgaatttacgacgttactccaaaggcttttctttaactattttgcttgatgtatattcaacaatgatagtctcaaacaaacaaacaaaaaacagaccacacatctgatttttcaccaatactgtttatagaatgaacctgtatagagtctgaggctattctgatgataaattgactataggactagaaaaaactattttgccattttacaaacgctcattatgcaccttatataatagtgccaagttaataaatttgcttctatgtttatagtctgcaacggaaaaaacttacgaggtactattttccagatgaaagtgaaagtgatgacagattttatttcttcacttaaattattaagatatacctttattatgtgagcataatcgattttattgcagggaagtcccttaattcagtaaaaaagacaggattgcttcttgaatattaaaacattttcatcttttcagttttgcttttcttgattatctatttttctttttactgagtagtgtatatcattttttaattaaatataatttaaataatattttacaataatctaaaatgcttctgaatacttcgtcaataacttttggatgttcaataacattaagaacgattacatttttcaaatattatttttgcattatttatatgtttgcatttttacaagtgttctaatcgcatattgcaaggccaaatcagaatttttaaagactttattttattaacatttaattatagcaacaattaagaaataaaacaaaatgacataaaattttaaatcatatgaataaattaaacctatatatttaaattactttacaattttagtatttttcataaatgtacagaaatttcattttgtgtctgttgttattacaatattaaaattatgtaatggaaaaataaattaagcatcaattaagacagcatacatctgttgacaaaagaaagagaaggtatatttgatttccttgattttttcctctcaaaattgagaaatagtttaattttataaatctatatccatttaaattacttaagtcaccattttagcctaattttttcattttctagatagattactcttttttttttttttttaaaggtatcatttattctggttacgggtaaaagacaactttagatgtgcaaatatttagatatataatcacaattagtatttttacttcatgaaatctttaggcgcaaactttgctgttctaaactaaaatttggattccaattcaaaagctaaagactatcatagtgtgattatcccaaatgaactcttttacctaacacttactgaaatttcaagataagtagtattgagattctacaagtcagtaagaggtcttctccctgtgaacttttaggttttaagggcacaaggaatttaatggctactgggctaaagaatgtaataaccactattgtgcatatgattttagtcatataggcaaaaagcctaggagttacattgtttggtcagatggcataagtacaattaattgcaatataaattgtcagattgtttcaaaaagctctacaataaattattcttcaccagaaatatatgagagaacactagaaacaataagtcctatagatatctttaaatgctacctatttgatggtttttctggtgacattcctgtgttattttaatttgtattttctttaccacccatgaatcttaacagatttttctatgaaagttcagcactttgattcattcttctgtggactgactgcctgtgcctatccacttccctggctctcttgcttggtgtgtgcatgtggcttagttttagcaaatagaatatttgctgtccctgagccttagtcttaaatccttatacaagcactttttcttgttatcttacctgtttgtctgacttgggtgatgattcttagagtaattttggttgccaaatgttaaagttagtagaactactataagcctctgagtggctaaatggtagttatttctgtggcctgaatactcttatgagatattcagagagattgagagggaagaattatttttgaagacatggaatttttattttctattccttagaacagtttagtttaccctaaatagtaactacctattattttcctctgctaatttttcttgaggctcctaactttatcaggtgaattttaagacatctgtgaggctgggcacggtggctcacacctgtaatcccagcactttgggaggctgaggcaggcggatcacgaggccaggagttcaagaccagcctggccaacatggtgaaacctcgtctctactaaaaagaaaaaaaaatagctaagtgtggtggcggtcgcctgcagttccaactactcgggaggttgaggcaggagaattgtctgaacccgggaggtggaggttgcagtgagccgagatcgtgccactgcataccagcctgggtgacaggcaagactatatctcaaaataaatacatacatacatacatacatacatacatacaaacacatatatgtaatgtataaatattacctttttgtcatctatttaacaaaatatttgctcaaatatatccttccatctgacaactatttaacattacttttctaatatttttaccttattgctgctgacttgatacatttttattcattccactacatccttgttattttggaagatctatcctttatttctttattaaggggtatcttcaattttttgacctcacaattagatgcataattttcaagtactatttgaaataaagatgccttctattgtcttagcaaattagtcaatttctctacttacccctcctcaataagttgacaaattcaaaaaacataaatttccccatttctttttcaccactcccctccaagaaaccttggaaccagtttgttccaaggtttgttcccaccaaagtctagattatacaaaaatattttagaatgttaacgatatattgttagtaaaattcttctattgaatagtttatgataatttgtcaacatgaaatgttaggcagacattgaataccaactagagctattcatattctcttaacgggatttccattgagttattgatgaaagataaagtgatataaagaaaatgtgtatacaccgagtgcaaaatattttataccctttatgtggccatgaatattaaatcacagttatgggaggaaattgccaaatacatatattaggctgttaaaaactgtttttctgagctctggaaactgatggataggcatagcagaagagagcagaagcaagccaagaaatcaaggaaaggatacagctatataacaagaaataaaataaaagtacgtaatgtaattcccttagaaaatgaagtagggtgactgagaagatgtggagaacctttataccaatttcctttttctaatcagatttgattataaaacatcgacataaaatcaatatatgtgcattatattcatttcaattttaacttcaagacctaattttgctgtcttaaagatcatggataactccatcttaactcagtgttcaatctataattcattaaaacagttttcaaaagaattttcaaaatactttattatgattacaaccatacttaatcttcaattaggacatactatgtgataaatactatggtgaagtacttctcaataatccatattcttaaacacaacaagttctaggatcaaactgcttaaatttatatatttgctcaatcatttgcaacataaatattttacagatgaagaaactaaaacacttttttttttctccgaaactgtttcagggctaactaacttactcatgagcttggtaaaaataaaaattattagataccttgtggatccgttgcatatatttcaaatttaagtttttgaagcactttttgaaaagacttctttatgtgacatttgttcattaaaaacacagtgattcttttttgaaatacgatccaattgtaaaatatcctgtgtctagaaatgaatttattttcctaacaaaaatgaattaaattaattaattaattaaattctcagaaccattatttaaaccaagtgtgttgatcctacaaccagtgaaaataatccctacaatgctaaaaatgtgtgtgctattatccatctatttcctagttcattaaagccaagttatcataatctggactttttaccaaagattttcagggatgtcaaaggtttttactcctaaatttaatatgctgaaatattactttatgttctatttatttttattcatttaaaataacatttttctctatgttgcgattgcaaaaattaacttatttacatatatacatgatgtcatgatatactctaggcacaattttggatatttccttttcccaatctgtttaacttacacaggtaatcaatatatgtaatcaccaagcaaaagaccttccttggtttctattttgttattttttcctctggaaaagagtttaagatagttttaacatgaagaatagcaaccatattttttgcatactgttatttcttcaaagacgcttaatctatataaacaaattttaaaaaccctggtatcagttaggtaaaatctctgagatttaaaatatttactaagctactaaatgttaagcaacacgggattttgagagattggccaatggcaaggattgtaagggaacaaaaacttggaaacaatgctgtttgtcgacatcttgaataatttgctgtgcctctattttatgtcacggtatttccacttccaggcctatacaaataaataaaatcagtgttatacacagaataggtacacacacacacacaagcgttcagatataaagatttcaactgtagcatcatttgtaataaacaatattggaaacaatgttggtatatattgctaagaaaatgtgttgagatcaatttagtataattatataatgagatatatgattatttcatttctttatggaatgagtgtaatgggaaaatccagtggaaagcttacgttaaagctaagaaagttaaatctttaagacctttcatgtgtatgggtctttctcggggtcatatgagttttgcaaaatttgctatgtaagatgcttaattaaaaataagaaaagccacacctgttttgactcccatttgcctttagtcatttatctccctgtcaggtagtgcgggtccagcctacagcacttttagtattcagctaaggggaagttgaagagagacatatttaatttcagttcattgaggttaatgtgcttgatttaaagccacttccatgtaaaatgaatttgtttctggcagttcagagactttctattgctcactccatagattcatccagtgtcgtagcacagaggtgcagaggcaggaatgttgtgagacacatgtcatgcagtacttggtaccagaggctgcagagaaggaaagaaacagctgcccttaacctagctctcctttccactaattcttaccgtggtggtgatgtggtgagaaccagatgtcctacatgtaaggggatctgctgtaggcaaagaactctggaaaaaagaacctgagcatttttgtggaagagtgacccagttgctctgacccccttctgagtgcgtctccatagtcacaaaatggaaaaaaatctgagttcttactctaaccatttggataaaaataaatcactctaggggaaagataacactagagtctccagctttgtaacttctgggatgcatctactgggtctcatcttctcttgaaatgtaaatatatatccctagtgaggtaaatccctcaggatggcccctaaccatgttctttctgtgaattaatttccagagctagttcttagcgtagagcagaagtctgagtaaaatttgttgagaaagttcttactatgcataaataactttatttacagcctaacactatccattaaaatcaataagagaaagacaaactaatccaaaatgaccctgcaatcggggctctaaaacaatgcaggttgactgtaattgttaaaatgaatttggaaagtatttgaccttatctgttaaaattaagtatatgcataccctgtgaccaataattctgctactatcatccaacaggaacacataaacatattcagcaaatgtacaaaattttttattaaagaattattcacaacagcttaaattggaagttttgcagttatccatcaagagtaaaataaacacatcatagcatatatatacatacatggagcattatcaagcaagaaggataaatggtatacccaagagagctttgatgactctcctaaatatatttctgagtaacagaagccatccagaaaagaatatatattgtttaattctattataaaagttcaaaaataggttaaaaaaagtctatgttattagcaatcagaataataattacttgcagatagagcagatggtaatttaagggaattttattgtgaaatatgtacaatcactttgttaaaattaattaactatatactatttgtgtatttcaataaaaatgtttaataaactatctcatcgttgttatttacatttattaaatagcatttaggcatgggtgaaaaggtttaacttgactggcctgaattactcaaatactatacattccaaagaggggtccctctgcaggactagaccttagactaggagttcatctctgagcccttggagtattttgcttgataaaagtgttcttgttttcctaaagtcttgggccatactctcccagttggaccagaaaaggttatgttatcaacgtgacttatgtgaacatctgtttttactctgggtgtaggaagaaagttgtgcttaaatgtcatggagctgaggtcaatcatatgggcattacatgactatgtgactgatcccagtaaacaccttcgacaactagactccagcgagtgttcctggttggcaatgctttgtactttacatattgttgctgggataattaaacatgtccccatgcaactgctctgggaggggacacctgagagcttggacttggtttctcctggagttcacttcatttgtcttttctcttagctgacttctatctgtactgtttttactgtaatatactgtaacaatgagtactacagcttctgattcccttagagacttccaataaattaccaggtctcaagtggtcttgggaacccctggcatattactgaacttaaagttttcagaatatctgtatttggtatattccatggcaagcactatatccatcacactttttcatttattgacataactccaaatatttccacatatctaaaattcaggaaagtaaccctatccttacctctgaggataaagcttgttaagcataggtaaaccatgataatttaaattcacctgtttgtgactgactttttttaatgactgtttttagtcaagaaaatgtgaaggtaggtctgccaagagctactgaaaagagttacattttctaaaaaaaaaaaaaaatcctcatcttttctctttgagaataatttgtggtgtttctgaaatcattgtctgcccataaagagagattacttaaacaaaaagtctgtataaaatatgactacagagaaagatgagaaaaaaatcatattcttgattaatttattgatctattaaattaatagtctaggaagtagatccctctttggacttccagttagagacagggccttactctatggcccaggctggagtgtagtagtgccaccatagctcattgtgtagctcaccgcaacctcaaactcctggactcaagcaaacctcctgcctcagcctcccaagtggctggaatacagacaggtgccaccatgaacacacctggctatttttttttcagttgtagagctgaggtctccctatgttgctcaggctggttttgaactcctggcctccagtgagcctcccacctcagcctcccaaaatgctgggattccaggcataagccaccagacctggcctatttatagtttaaattttctcatcgtctaaataaaagatctaggccgggcgcggtggctcacgcctgtaatcccagcactttgggaggctgaggcgggtggaccatgaggtcaggagatcgagaccatcctggctaacaaggtgaaaccccgtctctactaaagatacaaaaaattagccgggcgcggtggcgggcgcctgtagtcccagctactggggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaagatctaaaactaattgtctaagttggtggagcagtcagaacacacacatttattgattaaattcattgtcttatatggatgtggttcatggtgcccaaaacaattacaatagtaacatcaaaggtcactggttacagattatcatatcaaatataattatagttaaaaagtttgaaatattgtgagatttacctagatatggcacagagatacaaatgaacacatgctattacaaagtggtgccaataaagttgcttgatgcagggtggtcataaaccttcaatttgtgtaaaacacattatctgtgaagccaagtgaagcaaagcacaatcaattgaagtatgtctatattccactgcctttttagagtgtatatagttgtattacataacatacataatatatatacaaatatatataatatatatacaaatatatataatatatatacaaatatatatattatatatacaaatatatataatatatatatttgggtatatgtaatatatattatatatatttgtatatatattatacatacatattatatacatatatagtatacatatatattatacatatatattatatatatatatatatatttgatatggactgtgtcttgtttccccaaaattaatatattgaagccttaactctcaatgtgttagcatttggaggtgggacctttggaagtaattaggtttagatgagcccataaggatggggtcttcatgatgggattagtgctcttacaggaagagaccagagagctaacgctttctattcactatgtacgtacataggaaaaaggcagccctttgaaagcccagaagatgaccctcctcagacttgccaggttcaagaactataagaaataaatgtctattgttcagaccagcgcctatcttatttttatatagcagcctgagcttactaaaacaattattaagaaaaaacagcaaagcaaacaaacaaaagcaactatgtttaaaactcctggaaaaataatttatcttctgtgcagctgtttttttaagattttcctttaatgtatttcctctcatttttcttgcgtcttatttggagtctgtagtagcatagttcttaatttgcttatcaagtaatttacatcatattaaacatgaatttcaaccagcaaagaatattattaaaacttctggactaatgttattcacttgtattctttcctactacccggaaatgcttttgctggcaatgatttctcctttgatgttgtgaagtttcgggccattgttagagaaacaggtccacttgctgattagcaggcagtaggctttgtgacctaagttcagtaacagaagatcattactttctctggcaatttgatacaacatgcttcatatattccaaaattcatcaattttctgctccgttgatgtcctcctttattatgttaaagagttgccacagtatagtttattcataatgctattttcagttgaattactagagctccactttagcattttaaaatcatattatcgcatgtttatttccaaattaaaatcctctcttaaaaatcagggatatcagtattcatctctttttatgtaaaaatattaaaaaattagaagtgaaatatcacagaagatattttaaatatgaagacaaataatgaaataaggagaattttaaaagccaaatattttggatcagagtaagaagttagtggtaaaagataaaggttatccaacaaccttttgcaaatgaagccaaaaaagtaggtttgtgcaacagtgaataactaaaattacaactcttttatatttcattaaaaaacatgccctttttcaaaatgtcagatcggtttaatcacaccataaaattatttacccaaagttaaggaaaaatagcatactgtcatataagtagaaaatttaaatacacaattgatatttaacgttctctaagcaatgtaaagatttcttttaagacatctaacagagttgtatttattattagggatcaaaaagtgtgtaaattagcacaatatattttatataaaatgaatctgattgtgttttctcttataagagtatacaattataattctgaattttgaatttattcttaaacaaataaaaacaactgctatatctgaattcttgttttatgtcactcttgtgcatattttttactatctatattttaggcattttctaggtttaagtatgcacagttggagcttactcaatatagcctagcaatgctccctgtttcttttttttaacctttaatttcaggggtacatgtgcaggtttgttatataaatacatttgcatcatgggggtttgttttacagattaattcattacccaggcattaagcctatgactcattagttatttttccagatggtctccctcccccgaccttctgccctcttgcaggccccggtgtctgttgttcccttctttgtgtgcatgtgttctcatcatttagcttgcacttacaagtgagagaatgtggcatttgttttttcgttcctacattcatttgctaaggataatggccttcaattccatccatattccttcagaacacatgatctcattcctttttatggctacatcttattccctggtgtatatgttcaacattttatttatccagtctttactattgatggccatttaggtctattccatgtctttgttaatgtgaatagtgctgcagtgaacatatgtgtgcgtgtgtctttataatagaacaatgtatattcctttggatatatacccagtaatgggattgctgggtctaatggtagttctgtttttaggtctttgaggaatcaccacactgttttccacaatggctgaattaatttacattccctttaacagtgtatagtgttcctttttctctgcaaccttaccagcacctgctattttttgactttttaataatagccgttctgactggtgtgcttactggttcttaatctcacccacatcttagaataatgtggaacatttcaaactacccacacctctttctaaaaactgaagttctgttttaattggactttagtagagccaagaaatgagtattacttaaaatcttgccatgtgattctactaggaagccagggttcagagccatggattacatttttaatataaatacacattattagttgaagcagttttaagttaggatagctgtaacgttgattgaaaggggaatacttaaaacagaaccctgccttaggtcgtcaagacttaaaaaattcttctgtttttattctattaaatataatcatgcattcatttactttagcatttataattctaaaacacattgcaaatttcacaaaactaccattttctaaatgtcaacactctaaatacaccatttatttttcaaagtagtatattcacttcaaattccattgctgtgtcaagagttagttgaacttaaaatataattaatagttactcagcaaaaatagaaagatgttagctgactgtgtcaaaagaaatattttaacactgatttcatttttactaaatgactgaatttttctttatattttatgcttaagcttctctgctttctttctattttttgtggtttaaataaagaaccatgattatctgtataactgattgctcaaagtaattaatcatttttcttatgaaattaccagggtaaattaagaatcataattacagagttttctcttgtctagaggaaacatactgagaaactgtgttaggaaattattatttcaaaacccagtctaagttctcagccactggactttaaaaaatacatattacatatactttttctaacatgattgagaatatagtttgtttcagatttccacatttcttaaatgaaaacaataaagaattcaaaaggcaaaaggtactgtaaaaaaaaaggtattcgatctcatgtaaatgagaatcctacactctcactgaattttactagaggggaacttattgtcacatcagattgtttgttcaagacactatttctgatgtattttattaaagaattcaaaaggcaaaggtattgtaaaaaaagttatttgatcacatgtaaatgaaaattctaccttcttattgaattttactaattagagggataattattctcgcatcaggttatttgccaagatactatttctgatctattttattaaaagtcaccatttatcattggttttcatctcatgttatatatgcaaatgaaactcctttgagtatgcaacggttatttactgcagtgaatatcgtataatcatatttatcaaaatgttcttctttgaaatatttttctagtgcttattagcaaacagtttttatatttgagaaagtgaaacgtggactttagaatcagatttaggccatatggtaagccagttgcctgaaaaatcttcataacaaatgctaatattgatgaattttggagatgtcattatatatgtatacctaaaactacaggaaaacaaagaaacttaccaatgccagaaacacaggcaacacttaaaaccagcaagaccagttgctctgacttttctggatggcaagagagatggacccagcaatttataaatttggatttttttttttttttttttttttttgagacggagtctcgctctgtggcccaggcgggactgcagtggcgcaatctcggctcactgcaagctccgcctcccgggttgacgccattctcctgcctcagcctctcgagtagctgggactacaggcgcccgccatcacgcccggctaatttttttttgtatttttagtagagacggggtttcaccgtgttagccaggatggtctcgatctcctgacctcgtgatccacccgcctcggcctcccaaagtgctgggattacaagcgtgagccaccgcgcccggccaaatttggattttcttaatgctcatcagcgaaggggtgatgcatagctggacctagattgaaagagtaaagaaaaatacttattaaccaacccagtataattaagaagtttgtctgtaaatactagaacaattggtagaaaaaacaaatacatattctcccctgagaatctgtaacatcaggattatccatcatgtgttgtttgacttcaaatttttaaattgtacagccttgaaccatgaaccatcaaattaacaaattaacatatagattattttctggccattgatacactggaagttgggtggaagagatgcaaaatcattccagagcaaaagctgaaaatttttttctgcaaagggcaagataataaacatcttaggcattattgaccattttaaagagcagcttatagtcaccaaaaggaatatcaacaaactagaaagtgaagatgaagaattatccagaatgcagaatatgaaccaaaagatagaacataagataagctgaaagccatggaggattgaataaaactatccaaggaatatctaaaagaaattctgaaaagagaatagtaggaataaaaataatgggattataatagtttgcttctacttctgggatgaatgtagtagttgtataagacacatactcttattaaaatgacaagaaaaagctggataaattataaaagccatatattttttaaagcatgagggaactgtagaaacaatgatgaatagatgaactaagagtacagacatacctgagtgttcgaaatgggccaaagagcatgatgcattcatagcgtctactagtcaattctggcacaaattaggaagtagaaggcatgttcaatggaggcaaaacagtaatatatatataaacatgtgggtaagtctaaagaagcatttgctatattgaatcaaacaaatacaataaagtaaaacaaatactagagaacatcgttaagctgagttaagtttggctcaaagtgcccattgtacttgcctaattaagtttggcccaaagcggcatccatacatagtgactgtactctaacttaatgtgtagataagttgtaagctaatgtagatatatggacttgtaaccaagcaactgagactcaaccaatcataggagccaaacccttagtcaatcctaggctgaatgctgccaaattatgcccaaataaggcaaatattgaactgcaccaatcagggaaactctgaatataattgtatatgttctggttataaatacatctcaccactctggatgtggagtcactctgaacaatctttgttctgggatggtgcctacttctcaaacctttttcttggtcaaataaacttagtgaaatttaacatgtcttagttgcattttttttaaacaacattcaaagacctacaaaataggacagggaacttgtatttagactatactgtctaaatgcaacgtatttatgctagttatttgtgtgttatagagaatatagtgatattgatatactttaagtcatttatgtacatcgggaagaggaaaaaaaagttacccaattcaatggaagtcaaacgaagaagcagaacagagctaccagaaaaacatgataagagttaaagaagatgggagctcaaagaggaaaactgtcactgaatttggggaacttttccttgcaagccaagttaacttttattcagatagaattctcagatgaaaaagaaattatagtctatggctgacaaaatatagagagtctgcccagagacttttgctattctaagctagaatcataaggttaatacactccaatgaaggagaaaacaagaaccagctcttgagcatacttgaagtctgggaccaaatctgagttgttcagatactcatattttcaccctgatttaagatgatctgatatgggtaatgcttgcataagcaaaacttctggaggaacttacctccatagtagacaacaaggtaatcttaaactatcctgacactaattgggtgtataaacttggccaagtaatttttccctttgagtctcagtttcctcaactgtaacgtgaatatgaaagtaactaacttgtaggtctatattaaaaataaagtcaattattttggtaaatcatttgtatgcaatatagcatacatgagagagagagagagagtttgtatgcatgtgtttagagagacatggagagagagacacacatacacagagaagaatcagtatattgttaaggataacaacatccagaaacaaatcgacagacaagaaaaacaatttaaataatagaattatcagacagaagttaaagaacaaaacataggcttaaagatgcacataggaaaatacaaatatgatcatggtagatttagaaaggaaatacctgctagaagtaacagagaactactagaaaattaacgaagtgcagtaggaagaaagaaaataaattattgaagaaaagtttcaagatacaaaggataaagttaaatgttaatatatgtctaaactttaccaggaaaagagagacaaaggcaataactaaggaaataatagagaatgtttttagtactgattgaagacagatataagcagatttaagaaggtcaacaaattctgagtggagtaagaaaagtacaatgaagaaaacaaaagacaaagccaaaattctgtaaagcagcctgaaaataaggcttattaccattaaataacaacatttcagtctatagaaacttacatcctaggagagggaatactttaaataaaaaagtaatggatgaaaagagaaaaattccatcaagtgggataactgttatccataaagaagtagcaggtgagatggggagtaaaaaaacaaacatatataaatcctcttattttatatattatagctcaattttattcccatctttgataatccaaaaattatacactgatcaatatatctgttctaaatgttaagattccaacaggtagatcatgtctctcaaaatgtgttgcacattgcctcaactggaggttcatgatgcatattaaaataagaaaggcttagagaattcttacagcaaggaaaacaatgtaagtttatttaatttagtgttttagctatatatttaataattattttaggtaggcagttgtttaaagacaatagaaattacttggaatttaaagcaagcaaaaatgaatgcgttggaaaagcacaatgcagctcttagaattgaaaaaaaaagtaggtgaaccagcctcaggcaggaatcagagagcaagtcagaaccaatatcagaaaaaggaagttctgcttttcatgtggctattgtcctgtcagtcatgaccgctggccactgccagcaaagcatgcacaggcattttctggaatgctgctgggctctgctttagcttgtcacttcccactttaccattggattcaaaaaatctatccatctgacaggaataatttcagactctctgcctacttcttaccttgcaaggttaaaaatgcaaggaatgagtggctattcttgggtctctggtttacattttagcctccagttggtgggaagagaaaaatctactcacaaacagcttcaaaacggaaaggtcctatattggcattcctacataaaagaaagtactggggggcttgacaaatggacatttgtcttcaaagaacacatattctcctttagacaaagtttgcacttatatagcacaattaacctacttcttatcaatcaataaaacgaagagacaattacagaacaggataaggtgtttgcaaactatgtattcaacaaggtttgatatccagaatatataaggaactcaaaaaactcaatagcaaaagaaaaagttgattaaaaaatggacaaaagaagacatacaaatggccaaaaaatatataaagaaatgctcaacatcattaagcctcagaaaaatgcaaaacaaaaccgcaatgagctattaccttatcccagtttaaatgatggatattatcaagaagacaaaatataacaaatggaaacgataatgtggagaaagaggaatgttacacactgttggtgggaatttaaaatagtatagctgttatgaaaagcagtatggagtttccacaaaaaataaaaaagagaactattatattacccagcaatcccactactgggtacgtaatcaaaaaaaatgaaattagtatgtcaaagagacatctgcacccagggatattgaagcatcattcaaaatagccgtgatatggaatctgcctaaatgctcatctaacaacaaatggataaagaaaatgtggtgtataaatgtatatctatctatctatctatctatctatctatctatctatctatcatctatctatttatcatctatctatccacccctccagaacaatattcagccataaaatgctgttatttttagcaatgtggatgaagttggaggacactttgttaagtgaaataagccaggcacagaaagacaagcactgcatgatcaaattcatatctggagttttaaggatatggagaaagatgttaggttttttccttgtgtgaacaatatttaaaattattatatttggagagataactagaatacttctgccaacttaactatgacccattgaattgctctgaattataaatcagatactctgaattagcacttcactaccatttttaaatctacagcatttatataaattaataactgctgtagagcatactactcatggctgaaaaaagtgacctgatgattcgagctatctaagacccacctgatgtctgacagcactaaggatcaagctatcacctctcccttaacacatctttcacaccagtgtgctagagcagatagctgaaaagttttccctaagccagagatcattctgacaaggcatgtggaacaatggagatgtcagcatgctttcaagacaagtaacagtaatcctggctgttaacttgctttaataataatgaattcttttatcaagtcctgaggaatgagggcttccaggtgccgtatttccaggtgcttatcagaatttttctttgctgataagaacaattgttgcagcatgctttgctaatcatatacagaaagacaagaaatttatattctaataatagaacacaagtccatctcttgcatctgatttagccagattaagtcacctttccaccaatatcaatctggaagtgatatcatgaactaaatggtgtcaacctggggtttgtattatatctcgacaaaggaaaagaagttgccatcattggcaaggtacatacaggatacatctctgtttcggcagatgggatgagatttccctgattctcctacactgcagagggtagagggaggtatttatataatacacagaattttaattgaagaagcaaagaggaatggattaatgggattaatagtgtttatccaatacaagataaaaaacaacatattattgtttgtatcatgatggttctagaataaaacacatcatttctctaattttagttagatctttgctgaaagaaaaagataaataaaataccctacagtttatccatatccatgttcctctacactaaatattcatctttgattagttatttttaactatatttgatttctttataaattaccttttgaaactttaaacacataaagacattgtttccccttaaaagatttttcttttcctttctttttttttaatctaaaacttactttcaaaaacaatgactttcataaacttgcaacttgttaaatatagtatttttattaacattctagtttgtaacacaaggcaaaacctaaacacttaccatttataaataatgggtaatactgtttcaacttaaccttgagaatgtagaaaaaaaattgagtccagtctgatagcaaccaaaagatctcagaaacagtaatcttagtgctcgcctggcagacacaatctgcacagaacttaatcaaaataagattaaaagtccatagcaatttccttgagtggccagtcagatatcccccattacagtcaccaaccagcctgcccctggggcctatttcagaaataaattggtttgcagatgagctgatgcagaagaaggaaaaaaaaatgttttcttgagactgtacctaaatcttatcaagtaatacagggaagcttcaaagtctttttattctgaaatgttattttattctgctttatatcatcttaaatttattagtattatattaaatattagtttatgtaagcttattatttgactctgtataggatataatagatggcattgaatatttaataagatagcaacagcaataacacctgggaaattgttcagggaaggattctattcagttattaaaagatttgcatacttatttcactaatattactagcaatcacaagcattgggtaatgctagacaaatctgcaagaggtaccgttattccagcaccttaaaaacatttttcaatctgaaagatacttctagatgtttttttccataacagagcagatgatttctaagtgtttatatcactgaaacttcacagtattagtggaatatgttatcctttataccaaaagtaatcagattattttataaagcaattatcaattaaaagtagattactaagaacatactgtataaaatgccttatgggctattaattctgcatgcattgccacatttgattgtctcaaaaaacctcctgaaatatgtattcttaacacacttttactgagaacattatgagtaataaaagttgaaagattttcccaaagatgtacaagtaaaacaggtcctcaaataaagttgttttattcaatgttgttttgctataatgtagatgagaataaatattgattcctggacagggctaccatctgtgtagggtctgcatgttctccccatgcctgcatgggttttctccaggaagtcctgcttcctctcacatccccaagatgtgcatgtctggttaattggcatttccccactgtgtgtcccaatgtgagtgaatgtggttgtgccctgccatggaatagcatcctgtgcagggtttattcctgcattgcatgctgagtaagaataggttcttgccacccgagactctgaactggaataattgggtaaataatcatcttacttgtttttattaatctttttaaaaatgtatgtatacctcacacttatttcagtgttgaatgttataagtgttttagtctccatttagaagtacagtgataatattgtgaccagaaatatgcagtaggaacttatatcttgttgtatcaattggcctatggtaaaatttgtttcattgttcaccattttgctgatagttgcagtttccaataatctactgatattaaatgtggacttactatgtaaacaatagcaaggatcctaaatcctaggtcatatctaagtttaaatggcttgacaccaagtcagaattgccttatgaccatgctcttataagtgtttcattttttaaaacagtgcaaactgaattttgcatgagaattatcattaaaaaaatttttgttacagataggatcttgctatgttgcccaggttgaccttcaagttctgggttcaaatgatcctcttgcctcagcatccagtgtacctgggactacaactgtgtgccaccatacccagggctgcaggaaaagttgtgatttcataaagcagtgatttatgaaaataagactttatttgggcaacatagaaaacgtaaacaaaaagagttgctcaacataaaacttactcaagtcacaatttacctctgacatgacatatttccatccacttcagaaaaaaaagtgtatacctttttatttcttttttttttcctttttttttttttagacgggctggagtgcagtcacagttcactgcacctttgagctcctgggctaaagtaatcttcctttctcagcctcctgagtagttagaactaagacatgcaccaccatgtctggctaatttttaacacttttttgtggagatggagtctcgctatgttgcccaggctggtcttgaacttctggccacatgctatcctctcacctcgaccccccaaagtacttggattatcggctcaagtacttagatgtattaaccaggatcacagagagcttgattttgtaagtttgagtcagcatgtaataactgcagttgattttgatgcatgtatttaatgagaatcattgctttagactatatgatatttaaaacaaaagagcaataggactgcatggcacaatataaagtctgttatgacatagtgactttaatatattttaattaaaattataatagtaaaagctaaaaatgacaagacaattgttagaaatcatatcacgacagcataatcatgtatccacaagtgattgatacaataacatgaactgactttttgctgcaatattaatcagttaatacaggtttttaggtttcagttaactggttaatcataaaatattatataaaatattatcaaattgtgtaagtcatctcactgtattctaaaatttatgttattttatatttctaatctatgttttgcagagatcatgaaaattttactgggtaactgaagaagaattgtcccaaggacttgaataaatgttaatgttcataacagtatgttctaaaaagaaatttaagtaaaaaaggaaaaaacatatttcattttaaaaatatctacccatgcacatcattcatctaaaaaacccatttaatataatcatctagttatgtaaagatatacccaatagctacttaaaatagaaatattctatttcattattagaaattattattttaaaaggttgttaaaacatcaaaaatatgcttatttctagtaaccagagaacacagcagggttatgaaactttggattcctgtttgatttggcaggtaactagattaacaaaaatacaaggttttgagtttcaaaacagaatagcatatttaaaaaatacttggtgggtgtctggcaattgagagaccttagtagcacaatcattggtcttcacaatcactgccaggtactctttcaaactagcttgaataactgcaaaacacattatcaacccagcttctttttgctggacctgggcatatataaactgattagatttaaaaataaaaaagagttttttcagttgtgtttgaagaggtgaatccttggactcaaaatctctcaaaagtcctgtctttcacttcagaatctgcattaatttgcacaggaatatacttctgtgttttaataaacacatgcaatttttctgttttcatcttgcaagtaatgacagctttgttctcaaaccaattttgttttttgtagattttaccctgatatataatgaagagacagttgcatgatctgtgtagaaattcttcctctaaactaaattatactaccttagaaatctgacatgaaagtaccaaaactatgtaaattgacctcaccaagaaaattattacataaaacagtgattcatggaaataagacttgatttgggcaacatagaaagtattaaaactaaaaaggagttgcttgagataaaatttacccaagtgacaattttacctgtgacaaacatatttccatccactgcagaaacaaatgtgtttagtttattaaagtatatgtttaacagcaaaaaataaatagaataaatttattatccctatccagtgataaacacaattttaaaataaaaatgaaaacatcctgcttatatttgctatactatttcatgcattaggctaagatatatggttatttccatgctttcaggatgtgtttaacaaatctcttatacattttcctattgttgtcattttaatatcttgaatataatattaaataaacatttctacaaataatttgaacctcaaagtttcataaacatctatccttcaatatttaggcctaaaaagtaatctccattatctatcaaattctaaatttgaacttactatggtttactcctactttttaattattactttggttaaagatacttcatgatattattaagttccttactaataatgtatatggttgtattacattcatttatccatcaagactaactttgagctactatgaaatataattcaaatcattcacataatatctaatgaatgattactataatacaaagcactatactaggtttcataagtgatacaaaaacaagtgcaaccgcctcagtaaccaacacatttgcagtctaatagaggaaaacaagccctgttataagaataattatagtaaaaggctatataaaatacaatccattttgagacacaccttcaactctatttgctaattctcattttcactctttagtttatttttagattaaatagttattttcacaaatcagtctgaggacagagttttttgttttgttttgttttgttttgttttgttttgttttgtttttgtgagtcatcagcactatgcaattgcatatacctgttgtgtttagtctacaaaggctgaacatcatgtaatagtttttatgcattttgttcataggttactgggtgctttaaggcaaaactgaatgagtttccaatagtcagtacaaaactacaagaaatacaggcacaaagtgcctggggttatcctcagatgaagttagatttgaattgcattcaataaccttttttacaatgtgtagatgctcaaagcaaatacaatagtttctctttgcctctgtgacttgagttcatagtgttgtgtttaaatataacttttgtaatgtctacttcactgaagaaacttttaaaaaatttgacttataatggttttctgtaataacctatggtgcttggtttgtaaagtaaaacaggaactcaatttagtacctactgaataataacattttttaactgagattccactcataaggcacctaaatttttaaagttaaaacatattatattgacattaaatttaaaaagaataaacaagttagagaagaaataaaaaaaaatcttcagagaataaactgcttccaagtacacaagtactaaagaggctacacactggtatgctcattataaataaaaacattcattcatgtaattttatctcattactacatatttaaaataatctcttatcattatagtaggccatcattttccaaatagcatcaagaatccttattttgaaatagtaatcagatcatgtagttctcctgatcagatctcttcacactctagaataagatgcataccttcattttagcttttagactttttttctgatctagctctagattattgtttgatctcatttttactattcttctcattgctcattcaattcaatttcaagcataatgattttttgctctttttggaatacactagctttttgatttcattagagcctgtacacttccctcttcctgaaatgttcttccccaaatttatgtatagcttattttctctctttgttcagggctcagtgtaattgtagattgttctctaccttgaatatgtcttacccctcatttgactggttttccttcataccaattatttgtattctaaaatattttatatttttctgttgacttgttcactgagttccttcctctaaaatgtagcttcatgaggtcaatattttgttaaaattgtatgctactgtatcactagaactgagaacaatgcctgaacagagtagctactcatgactcattggctaaaacaagttaatgaatgagaacaggcaggtagaaagccaggaaggaaaagaggatattatattaagttgaatgagggattaaatgaatataaataagctgaaagtagcataggttatgcaatatgcttaacaaagtatgtttgtctattttcgttatgtaatccaaaacctggccgaccacaaaacttgctttttattcactttctctttcttccctgtttagtgcagcataaaattagttatcgattttatctcttaatgctccacctctattagtgaaaggatcttctcttatcatatttccagtccaaagttcagtggaaactttttacactcttacagtctatttgaaatccttatatcataaacataccagcacttatcccagcactattcacagtagcaaagatactgaatcaacctaagtgtccaccaatagatgatttgataaagaaaatgtgagatggtaccatctcactccagttagaatggagatcactaaaaagtcagaaaacaacagatactggagagaatgtggagcaataggaatgcttttacactgttggtgggagtgtaaattagtttaaccattgtggaagacagtgtggaaatttttcagggatctagaactagaaagaccttttgacccagcaatcccattactgggtatatacccaaaggattataaatcatcctactctgaagacacatgcacacatatgtttattgcagcactgttcacaatagcaaagacttggaaccaacccaaatgcccaccaacgatagactggataaagaaaatgtggcacatatgcatcatggaatactatgcagccataaaaaatgatgagttcatgtcctttgcagggacatgaatgaaactggcaaacatcattctcagcaagctaacacaagaacagaaaaccaaacactgcatgctctcactcataagtgggagctgaacaatgagaatacatggacacaaggaggggaacatcacactccacagcctgtcagagggtgaggggctaggggagggatagcatttagagaaagacctaatgtagatgacaggttgatgagtgcagcaaaccactatggcacgtgtatacctacataacaaacctgcaagttctgcacatgtaccccagaacttaaagtataataaaaaagatttccacctaaagataagaagatatgatgatatacacagtggaatacaattcagcctttaaaaataatatactcatgaaacatgtattttggagcagtttggatggaactggaggacattatcttagatgaaagtcagacacagaaagacagatactgcatgttctcatttatcaatgggaggtaattaatgcattcacatggacatagagtgtgcaatgatagagacttggacatgaagacttggaagagttgggggagagtgagaggggagtaaatgataagaaattacttaataagtacaaggtatgctttttaggtgatgaatatgctgaacatcctgacttcactatgcaacctatggatgtaacaaaattacagttgcactccataaatttatagaaataaaataaaataaattacattttaatagagacactatcagagaaatacaccgaaatgactggactgaattggaaatggaaaatgtagaaatctcattttctcttcagagactattgcaaatttgtatgtatgtaatacactaatcacatcagatgccagttttaagaacatattttcctccactgtgtagatttgtttcaatacggaaaaatttcagaacatacgtaatcaatacaaagccattctcagtaatttattttcattccatgccatgttacttaggtttacatttactaccttagaaaacattatgtacaaaagcttttctttcttatagtgaattaaatctccaactgcttttgtttctattttaagaaagtaaatattatgacataaatgtttgcaatgtttttgtttaaataaagtatttctagatttctcttaattcatagttacgtttgtttctttattgatgttcaaacacagacttttaaaaattcatatttttttcaaaatgtgtaactatttactttctagttcaatttaaaaagcatttaccataaaaatggcagtatctttttgtacagatgctacctctgaatcaaagcctctcagcaactggcaaacaggaagctctaatgcactttaaccctaatagttataaaatatgcaatcatctgaaatcacatactgatttccacttcttttctaactacggttatatgtaaatatttcactttcaataatagatctttgcctgtttatttagtttttttttttccttggcttagaaatagtttttatgaaatattcaaatacaaacatagtctctaaaagcaaagtatggttctttgacagccaaaacactttcccctaagcatttcattagttatataagtgataaatgtttttctgaatgggaatttacctaaagtgtttcaaaattaggtgaccatttgtgctttccaaaccatacagaactttatatttattcctgggtaaatcacccatttccttgttcatcaagatcaggtgaaatgatatccatgtgagataattaattcctctgctatctattttattatacttagttattcatctaaaataaatatctactataacaagtaaaatatataatagtgtagaagacaacaagagtatgtgtttgcagtatgtgtaatagagttaaatatatctaaatatagtatatctgtactaaggcaatgaacatcaattgtagctaatcaccctcattaaagcaaagggcactaccatatgtgacatagttgtcattgacagcctgttaaatcttgtagctgaggtaacggacagggaagagtttgtgatagtgaaatttgtagaactaagatcaaattaccaaacacgtaggcattattaaacaaattctcaccaattacttcaaaaatattgtaacttctatttaatatttcttgtttttaatcttaaaaactctaaattgagtagaatttgaaatagcagtaaatttcaggttaatggaaatacaatcacacttgttattattgttcaattttttttattaagtctgaagaaatatttacttgaatatgacatctaagaatgatggacaaaagctttttaaattttctttccactcctttttctgaaagctttgatacaaaaatcatttgacacaaatggttttttttttgtgtgacaggatcttactatgttgcccaggctgaagtgcagtgtgctcatgcaatcctcccatctcagcctcctgagtaactgggactacaggcacatgccgccatgcccagctaatttttgtatctttagtagaaacaaggttttgccacattgcccaggctggtctccaactcgtgggctgaagtgatctgcccaccttggcctcccagtgttctgggattacaggagtgagccactgtacccggctgatgcaaatgatttctattattaatatcttgcagttattcttccattggataaccatcaatgtcaaaataaagattattagttactgaaggactgaaaaatcaaaaatcaacttcatgagatgctttacaaacaagtgttctcttttaatatttgactcagtaaaagtttttaagaaaagttaagtttgtgtttttatttgtgtatactctctagtgcttaaatgtatcaggatagaacttttctaaactaggtcagtcttttttccatatctatggttgaatacttcagttaaataaagcaatggtagatagcaaactatgttataattggcattttgggcacttgttgcaattaattgccaaaaaaagcatatctcaccacaattgatctctcgtttttccactctcatttatttcccttcactttcttcttggcttctgcaaaagcatttgtttttcctttttctttcttctttaaaaaaatatatttgaagagatttattctaagccaaatatgagtaaccatggccagtgacacagcactcaggaggtcctgagaacatgtgcccaaggtggttgggatgcagcttgcttttatacattttagagaggcatgagacatcaattaactacacttaagaaatacatcagtttgatccagaaaggtgggacaactcaaagcagagggagtgggggtgggaggggttggggctggcaggggggttgggggatgggagggtattggggtttgggggttggttccaggctataggtgaatttaaacattttctggttgataattggttgagtttgattcaagacctgggaatgatagaaagggaatgttcaggttaagataaaagactgtggagaccaaggttcttttgaagtcttacagtggctgcccttagagacaataaatgacaagtgtttcctattcagatctttaaaaggtactagacttttagttaatctctttagaactgcgagggccattttttcatattataatttatctccttcatgtctgtaacaaagataggaatcgctataaagtgtcttcccagtttctgcctaaccacatccctggatttcctggctcctggcttggcatatgtttggggttagccttctcccactgctaatttgtatgccataagatggttgttttgttcctcagtacatttatgtcagatataattgttactgtagtaaacaactattgtgtaaaaaaatgataagtgagtgtgaaagtaaaaaaaacaaatcagaaaatgaagcagaatgtaaataattgataaagacaagttctgaaaaaatatcaaattggattgaggagtcagacacctgtaagaggtttatttgaggggctaagcgtgctggtatttacacacatattacttcttgtgtctcttcaatttattggttcatttcaaaaaaccaaagctaaaaatcataaaatattcattaggtaaaaagaaacaaagttcaatgaatccatacatacataccaaagacctttgtcggatagttgacaagtatatttgcatatatgttttccaaggtaaaagaaaatttgtggctgggcacggcaactcatgcctgcaatcccagcatttcgggaggccaaggccggtggatcagctgaagtcaggcatccaagaccagcctggccaacacggtgaaaccccatctctgctaaaaatacaaaaaaatagctgggcatggtggctggcacctgtaatcccagctacttgggaggccgaggcaggagaattgcttgaacccgggaggcagagtttgcagtaagctgagatcaagccactgcactacagcctgggcaacaagagtgaaactctgtctcaaaaaaaaaaaaaaaaaaaaaaaaaaaagaaagaaaaagaaaaaagaaaatttgtaggatatggataagtaatttattttagaagaattttttttttgtagaatgatttgtgctaaagcaatacatctctttctatcatatactgatatcttgaaaacttttataacgtttcttgtcacattcagtattttaaaaataggattgattctaagttttgagtttatggtgtatttgaatattagagatattatctcttatacatttcaaagctttgctgcattctaaactcagtcctgccttagccttagtaatggcaatgaagtgcggggatagaatgttcactatttttttatgtgctgttaaaatttcatacctcctgttctatcttgaagtcttacagttttggaatggtgagtgggggaaacaagcataaaactattacataattcatgcagttttcactgggcaacagtatcctctgaatggtgaaatggctacttttcatttatttatttttttctctcctggggtaaaacgcttgaaaactgcaccactgggaaattgcagctatagtccatgtttcaacatagtccatgcttctttgagttggccacttactgtttactctcatctccttaggtttagcagtaaagacctgtaagatttcttctgttaggatcatctagccattccaaacatttctcttagatttgattctttcaagacaaatcaacccaataaaaatctcataaataaaggtgagctagctaccacatttggtgtactcatctgaccaaaccaaattttatgtatacattcaattctcaatccaacccagtctgtttgcctaagccattccagacaaacttccactttgaaggttttaaatgcataagtcagatagcaatccttcagttgccccagaggcacatcacgttctttgaatgcttcagtatagtcctcttcatttagcaatcagtgaggcaatacactggcatcatgatccctttttttaggaactctgtacaaaattccctttgaaaatataaattttggaaatgagtgatgagcaaaggggtttcattaacattatcacaatctcttgatatatctgcttgataatgtagcacctattatttggggccattaggaccttggcagaaattctggtaaatgtaaagaaaccacatttaacatccagttaatttagtttgtttgtttgttttgtttttgtttttgtttttgagacgttgtcttactctgtcacccaggctagagtgcggtggtgtgatctcgactcactgcaacctccacctccaccttctgggttcaagcaattatcttcctcagcctgggattacaggaacccaccaccatgcccacctaattttgtatttttagtaaagacggggtttcactgtcttggtcaggctagtcttgaatgcctgacctcgtgatccacctgcctcgacctcccaaagtgctggaactacaggcatgagccaccttgcctggcctcaatattgtttttaataatttctgctttacttgcagttaatcatatcaggccgtctaccatacccagttgtgtcagcaagaagatctgtacaatgataagtaacacatggctcccagggctaacatattcctaacacttatataaacactttttcagaaatttgacaatattttataattaaacaatatcttattttacaagaaaagatatggtatcacaatactctgagcaaagagttaatttgcttctcaaatttcctagataatgaagtagtcctaaaatatttaactcagtattggtaatagtttcaatttgaggaagtgttctgaatagcctttttaatgctgatgtcataagattgtgttacaaacacagactttcatttaaagacactttatgtttaattttgttctaaaaaataaaattatatataaatacacatgtatcctaaactatatatgtataatatacatatatgtatatatatacacagagagagagagagagagagagagagagaaggagagagaaacagagacaaagaaagccataaatcctgaatttgttgttgtcaatggtgtttgatagcatcactttgtaactcaataggatgtatctgcacaaagctaaaattaatttatttttgccatacaaggcaagtgtatcttgttgacatctatagagaaaataaatcaccctctaaagaactgtttataaataaataattgatatctgaaaattcagaaaaagtaccactatcattttacttaccatattgcattgaaattatatgtttatgcttctcttgcttctacctctctgtgaattcaaggttagaaaaggagaaatttttatcttagcattcccaggaccaatcacaatatctaatacttagagcgtgcaatgttggttgaactgaaataaatctgatataaaaacaaataatgctttagggaagtgatttttcatttgagattattttctcagaaaaattaatatgaccaggttttcatcctatgcaaacattagtatgccttattgatttttcactaagttatatagcttatattataagacttttttatgggtgtctctacctacagattccaggcactaacaaacctgtagaaattcataaatttaatgcattttatcaagttgattaatatagcatgaacatttttgaactggcttcacaaatcatttattgttaaatgttattcttatacctgtattagagagaaaaaagccagaggtggcaaggtgatatacagatcaactggaaatccacaagttttggtttggaactctttggaaaattgaataaagagtcacaccttgctcaaaactgaattagtaaaagcgatgcacatatcaataaacaaacttctctaataaaaaaaagcattaaaaatatagtcagcatatatttttctggaatataaaattgaggaactagaataattcaacttgaataagtgtaactaattcattttctgcaaaatattacccacagtttgagtatttttctatttattctatcggaaaaaaatgatataccactgtactggaaatattcagaaaagtttgtctattttttaaaattgtacttattatacctttataaccgtgagataatatatttattatttgaatgagaattaaatgtttatgatttatacaaaaatgcctgacacagactactatgcccacaaaagttgaatggttgtttttagcttatatatacctatacaggttaatagatatatctttacttcttttttctttttttttgagacggagtctcactctgcagcccaggttggagtgcagtgacatgatctcggctcactgcaagctctgcctcccaagttcacgctgtcctcctacctcagcctcctgaatagctgggacaacaggtgcccgccaccacgcccgtcttattttttgtatttttagtagcgatagggtttcaccgtgttagccaggatggtctcaatctcttgacattgtgatccgcctgccgcagcctcccaaagtgctgggattataggcgcgagccaccgcacccggccaatatatctttacttcttataagaaatgagtaactttattaattctaccaacagataacattcttcctctcagagattaatatgcaatcatttcctaaccttattttattgcgctatattttaaatataataaacgtgtcaaaaatgtggtttcatactttttataaattgatatatttagctaattacactaaatctagaaaatactattgtgcttattcaaacttctcttctcttcttcagaggcaaacctgtataatttctttggtttgtttgtttgttttaagacgtagtcttactctgttacccaggctagagtgcagtggtacaatgtgaggtcactgcaacctccgcctcccgggttcaagcgattctccggcttcagcatcccaaataactcagattaaacccttataatttctatcatgattgattaattttgttcatcttcaaattccaataattagaattcctacaggatgtgtgtgtgagtgtgtatctggtttattttctttagcataaataaatatttgagatttagccaaatatttgtgtgtatcatttttttatttttcctcatatttctgagttgcctacgtatttgtcagagtttgcttattcattagtctgttagtgaatattcagattgctttcagaattagcttttacaaataaaggacttaggtgcattctcaaacaggtttttgtgtaaatatatgcttttatttttgttggataaatttctagaattgaaattgctgtgctatagggtagatgtatgttggccttattgagaagcgaattatttttcaaagcggttgttccactttttttttttttgagacacagtcttgcgctgccgtctgggctggagtgcactggcgtgatctgggctcaccgcaagctccacttctcaggttcacgccattctcctgcctcagcttcctgattagttgggactacaggcgcccgccaccatacccggctaattttttttttttttttttgtatttttagtagagacggggtttcaccatgttagccaggatagtctcgatctcatgaccccgtgatccgcccgcctcggccccccaaagtgctgggattacaggcatgagccaccgcgcccagccagttgttctattttacactctcacaagaaatagacacgacttctagtttccccacatatttgccaatattagtattatcattttaaatggtagtctttccagtttcgatgcattttggttgcatttccccttatctaataacactgagcatcttttcacattcttataagccacttgtatctcttgttttgtgaaatacctgttcaagattcttataactatttagtggatctcaggagtactctgtgcgttttgaacacgcaatttttttctcatacatttatcacagtctatggcttaaaattatattttcttacattttgcagttttattaggatacatttttaattaatatctacaatttatcaatttttactcttatgatagtgctttctctgttcagaaatatttttcctattataatagctcgcagatattgtttaatttttttcttttaaaagctttctgaattttgctttttcatttttatgcctacattaaaaatattggactagttttgtgtatacaaaggactgatgcatgtatttttttaatatgagaatgcatttatttcaaaagcctttgttaaagacttactttccccactgaattatctacatgcccttataaacatttaatttactgcataggtggaggtctaattttgaacccttctttatccttattatttttgtgttatgatgctttgatactgcagctttcttagatgtctgaaaattggctctatttttttctcaaaattctaggtcctgtgaattttccaaacaaattttggaaacagcttgtgaatttctctcaaaatgtttgccacaatttactacagagttgtagtaaatagatatagaattcattgtagtcaataaactacaaactatagattgcattgatgcttttttttttttttttttttgagacagaatctcaccttgtcacccaggttggagtgcagtggcacaatcttggctcactgcaacctcagcctcccagattcaagcaattatcctgcctcagcctcctgagtagctgggactacaggcccgtgccaccatgcctggctaatttttttgtattttttttttttagtagagacagggttttatcgtgttagccagtatagtcttgatctcctgaccttgtgatccgcccaccttggcctcccaaagtgctgggattacaggcatgagcaaccgcgcccagccgctactgcattgattctaaagattaacttccagagaattcacatcaatgttgcatcttcaaatctatgaacatggtagatctttacatttatttaagtcttctgtaatgtttctctacaagaaattttaaaaagttttagtgtgaaagatttttaaaggtttcacttaaattattcttaactatttttataccattaaaattttacttttaaatgtattctcaattgtttatttctagtatttagaaattccattaattttccatattatattttgtgtattgaccttgcattctacacattctgcaccattattgaatttgattcttattattcacagctttttaaataaatatattaggattttcttcatatacaatatacatatatatgttctgtgaataaaaatattttttcttttcacttttcaatttttatgcttttcatttcttaaccccatgcaagtccgaaatccagaggggcagccaaatcttaaagctccaaaatgatctcctttgactccatgtctcacatcctgatcatgcagatgcaagaggtgggttcccatggtattgggcagctctgcccctgtggctttgcgggatatagcctgccttctggctgcttttgtgggctggtgttgagtgtctgtggctttcccaggcacatggtgttgttggtggatctaacattctgaggtctggaggatggtggccctcttcccacaggtccaccaggcggtgccccagtagggactctgtgtgggggctcccacccaacatttcccttcctcactgccctagcagaggttatcaatgagggccccatctctgcagcaaacttttgcatgggcatccaggtgtttccatatatcttctgaaatctaagcagatgttcccaaacctcaattcttgatttctgtgcatccacaggctcaacaccacgtggaagctgccaaggcttggggcttccaccctatgaagcaacagctcaagctatactttggtcccttttagtcacagctggagtggctgggatgcagggcaccaacaccctacactgcacacagcatggggaccctgggcccagcaaaaccattttattctaggcctctgagactgtgatgggaagggctgctgtgaagacttctgacatgcccaggagacattttcaccattgtcttggggattgacattcagttcctcgttacttatgcaaatttctgcagccagcttaaatttctcctcagaaaacgggtttttctcttctatcacattgtcaggctgcaaattttctgaacttttatgctctgcttgccttataaaatgaatgcctttaaaagcacccaagtcacttcttcaacgctttgctgtttagaaatttcttctgtcagataccctaattcttctgtcaagttctaagtttcactaatctttagggcacgggcaaaatgctgccagtctctttgctaaaacataacaagagtcaactttgctctagtttctaacaagttcctcaactccatctgagaccacatcagcctggatctcattgttcacatcattatcagcgttttggtcaaagccattcaaaacgtctctaggaagttccaaactttcctgcattttcctgtcttctgctgagcccttcaaactgttccaacccctgcctgttacgcagttccaaaattgcttctgcattttcaggtatcttttcagcagcatcccactctactgataccagtttactgtattagtctgttttaatgctgctgataaagacatacccaagactgggcaattgacaaaagaaaaaaggtttaattggacttacagtttcatgtagctggggaagcctcacaatcatggtggaaggcaaagaggagcaagtcgtatcttacatggatggcagcaggcaaagagagcttgtgcaggaaaactcccccttataataaccatcagacctcatgagacttactcactatcaggaaaacagcacaggaaaagcctacctccatgattcaattacctcccaccaggttcctcccacaacgtatgggaattcaagatgagatttgggtggggacacagccaaaccacatcaatgaagctctctgttgtatatgttaatgctgataatgtttttttgttttgtttttgagatagagaaggagatcttagagacaaaaaaggggaagctccattaaaattggtaaaggaagaaacataatatgaaaggagggaaataatgaggtaaaagatgcagagactgctttccagacaaagtaagaatgaacttcactttggaataacaaagcagtgcttgcttggcaaggtgagtcttagaatctgactaacatcaacagggcagagtctcaggtaattaacaaaaccaggaaggaacagggagcagcaatgctaaaacacaagaaaccaggttactttgtcctacttcatagttgttattttcctaatcattggagataagctatgattaacagaaaaactacccatgtaaaatattgtcacccaacttttaagaaaaacaagaaagaagatacaaaacttagcaaacagaataagtaatttcagagaatcagaattaagaaaagaaacaaatgtaattacagtaagtgtaattcatatcttcagagacatgcaagaagaggttacattttagaaaatactgataatagctcttggattaaaaactcaacagatgttctgaagagaacaatagacatagttaaatatagatctagcaagtttgaagtttaaaagttgaataattttctctgaatccaatggctaggaaaaaatgaagaaaggtaaagggaggtaaagtgaagataaagaattgttgacgtaaagttgtttaaaatgctagaaaaaaaggaaagtaaacataaagatggaaataattaaagaactaatttaaatattttttagaactagaaatactgtagatttgagatttaaagttttcatagaagtatgaacttatattaatggagaaattctactgacagacatctcttgaagaagcaatgggatactaatgattaggacagaatcataaagacttccagagtaggaggatagaaaggtaattttcaatggaataagaagtagatagaaaatttattcttaaacatgtagatgttgttaataactgggacaagaccatcaatgtctgaagaaataaatgtttttacaaatagtgtcctataagtacccaaatacgcatttaattttgtggacaaagcaaagacaattgtgcatatctcccaattcccaagcatttaaaaatccaaaaataaaataataaaattaacaaacagatttttagaattatatctggcaggagtttggatcagtcatagagcgcaatagcatacttgaaaataaggacaatatagccattttaatgatattgattcttcctatccatgagcatagaatgttttttcatttgtttcatcctctctgatatctttggtgtttttagttcttacagagatctttcacctcactagttagttgtattcctaggtatttgattctttttgcagcaattgtgaatcagattgcattcctgatttggctctccgcttgactcttgttggtgtatgggaatgcgagtaatttttgtatgttctttttgtatcctgagactctgccaaaggtgtttttcatcttaaggagctttcgggccttaagcttttgggcctataaagttttctacatataggatcatgtaatccacagacagggatagtttgacgtcctttcttcctatttgggtaccctttatttctttctcttgcctaactgttttggcaaggacttccaatactatgttgaacaggagtggtgagagagggcatccttgtcttgtgcacaaaatacactaaaataaaattgcttaaaactagtgataaagaaaaattctcaaagcggccaatgacaaaaacacagtttgcacagaggaacaaaaaatgccagcaaacattttattggaaacaaagaaaattagaagataatgaagcaacatctttaaagtactggaagataaacattgtcagctgggaattgtagactcagagaaactatctttcaagatgtaggtgaaataaagattttgttcaggcacttagaacctgaaagaaatcatcaccagtaaaacaacactataaaaaatgttaaagaaaatgtttcaggcagaagtaaaataatatcaaaaggaaatttggatctacatagaagaatgaaaagcactggaaatggtatcaacatggttaaatatataagatccttttatttctgtttgaattcaattgattgtttaaacaaggggtcagcaagctatagcttcatgggtggactgcctgtttatgtgaacaaatttttactgagacacattcatgctcatttgtttatgtattatcaatgggtgctatagaattacaaaagcagaattaagtagttgtaacagagcctaatggcacacaagcctaaaatatttagcttttaaggaaagcatgtccggttctggtggctcatgcctgtaatcccagcattttgggaggccgagatgggcggatcacgaggtcaggaaattaagaccatcctgggcaacatgatgaaaccccgtatctactaaaaatacaaacattagctgggtgtggtggcatgtggctgtaatcccagctactcgggaggctgaggcaggacaatcgcttgaacccgggaggcagaggttgcagtgagctgagatggcactactgcactgcagcctggtacaaagctagactctgtctcaaaaaaaaaaaaaaaaaagagagagaagaaaacaacattattaacctctaatttaaacaagaataataacaatttataatgagcttacaacatatataaaaataaattaatgacaataacagaacaacagttaggataaaataatgaaaatgttgttacttcatgatactgtatgtaaagtagtatattataatttgaaggtagaatgtgatgagttaaacatgtatactacaaactcaaaagcaaccattaaaattaacaatatagagagttttaattctcaagtaaaaaaggagataagatgaaaccataaaatatatttaattcatagaaaagaaggcaaacaagagggaaaataagcaaaaaacagatgggatggtaggggaagcaaaattttattaccatcttcttagttttttttttttcctctgctaagcctgagaattaaattgacataagacagatcaacaggaaaatgcatacaaatttattttaatgcatgtattatgtggcatgcgagattctttaaggaaggaagactccatgacataatcacttatgttctgaagtagacacagagtagtaaattgtgaaatatgacaagacaaaggagctggaactagtgtagttaattgggtgaagaggtgattaacaggataagggttggtttaacaaggtctgtttgtacaggtttcccttgcctcaacttctcatcctgggtgatgagactgttactttccttcttgtataaagagggcaactttcatgtagaaattttacctcctacttttaagaaaaaggaaaatcagagtgctttaaaggaaaatcagagtgcttttcttgcatctgctatttttcaagtgtctttaactcaaaaaaatcaatatgccaaagtggcatgtttgggggtatctggttctgaattccttcaggaaagatagaaagcaaaagcaaaataataggtttaaaactaaaaatatccaggtgcggtggctcacgcctataatcccagcactttgggagactgaggtgggcagatcatgaggtcaggagttcgagaccagcctggccaacatagtgaaaccctgtctctactaaaaatacaaaaaattagccaggcatggtggtgggcacctgtaatgccagctactcagaaggctgaggcaggagaatggcttgaacccaggaggcagaggttgcagtgagccaagatcatcgcattgcactccagcctgggcaacagagccagactctgtctcaaaaaaaaaagaaaaaaaaaagaaaaaaaaatatatatatatgcacacataaccacattacatataaatggtctaaatataccaatttaaaagcagattggatcaataaaacaagatctaagttattactgtctagaagaaattcaagaatatcctaataaaagatatctatgtaaaaacaatagctggcatcatacttaatgaagaaaaatcagtttatttcccccgatttcaggaacaagatgagtccattaactcttagcactttgttttaacatttcactagacgttctaccaagtaaaatagacaaaaaacataaacaaaagaattacagacgggaaaggaaaatgtagattgggtttatttatagacggcatgtctatgtagaaagtccactgaaatctacaaaaacactgctggctataataagtgagttagcaacataaaaaagaaaaaaagcaacatattaaactaatatttccatataccggcaatgaacaataaaaaattaaaataaaagtactattaataatatcatgaaaaatgtagaagaattaggaattaatctatcaaatgatgtgagagtctggtacactaaaactcaaaacactgcagaaagttaaagaagacttaaataaatggaaagatgtaatatgaatatgggttagaaaattcacatggtaaaatgtgattatccctaaatatagattcaatacaatcccaattaaaatattattaggcattgttttataggaatttacacactaattttaaaacttcagtagaaatgcaaagagtctaaaatagccaaaataatccttaaaaataagaatatttttgaaggattagcacaatctaataccaaagcttataaggctacagtaatgaaaatagtgtgatattggcataaagatagacagaaatgtcattggaagataatagaaaattcagaaatatatgtacagaattttggtaaattggtgttctccaaagatacaaaggtaattcagtaaataaaagatagcccttcaacaaattctgctggaacaattagatactcatatgcaaaaagtagaactttaacatgtaactcatgatacaaaaattaatttagtacagatcatatgcctaaatgtaaaatgtaaaaacaaagtgaaaaaaaaggaagaaaaattatgtataggagaaaatatagaaaagtatttgacctcaggctagtaaatactacttagacatgacacaaacaccatttcatcaaagtagaaattgacaacttgagttcatcaaaatgtaaaacatatgttcctcaggaaacactgtaaaacaaatagaaatataagacactactgagaacaatatttgcaaaatatatgtctggcaaaaaagttgtgtccagaaaacataagaactctcaaaacttgatgataaatctaacaactctaataaaagtaggcaaatgacttaaatgaatacttcttctctaaagaacatatgtagatagaaagtaaacacatggaaagatcctcaatatcattagtcattagggaattaatctgtgtctgtcaaaaatgagttgggtacagttgctcaagcctgtaatcccagcactttggaaggtcaaggcagcagggtttcttgaccccaggagttagagagcagcctgggcaacatagtgagatcctgtctctacaaaaaagaaagagacatggcatggtgtctctatttagctaggcatggtggcacatgcttgtagtaccagctactcggaagctgaggtgggagaatcacttgagcccaggaggtggagcctgcagtgaactatggttgtgccaatgcactccagcctgcgtgacagagcaagaacccatctcaaaaaagaaaaaaagaggccaggcgcagtggctcacacctgtaatcgcagcactctgggaggtcaaggtgggtggatcacctgaggtcaagagatcgagaccagcctgaccaacatggtgaaaccccatctctactaaaaatacaaaaattagctgggcatggtgatgcgcgcctatatcccagctacttgggaggctgaggcaggagaactgtttgaactcgggaggtgtagattgcagtgagccgagatcgcgccattgaactccagcctgggcaacaagagtgaaacttcgtctcaaaaaaaaaaaaaaaaaaagaaagaaaaaagaatggctaaagttaaaaaggctggtcatgccaagtgttggcaatactatagaggacaaccaacatacatgcactgctaatggtaatggaaattagtacaatgactctggaaaaaggcttgacagtttttaaaatattttgacgtatgcacctatcatatgactgccaatcaatttgtagggaaatgaaagtatatgtacataaaaaacttgtaccaaaacattcacagcacttttttataggagagaggggctaatagtgaagagcatgtaacaatcaaatattcattaacagataaatgaataagcaagctttgatatatccatattttgaaatactacaagcaataaaagaaatgaaactttcatccatactataaaatagattaatctcaataaatatgctaattaatagaagctagatcaaaagagaacaaacagtatgatatcatttatataaaaagaggcattagagcctagtagttaagagtgcagcttctggaagcaaaatccttagtatgatgttttggctcattgactgcagcatttattttatgtgcgctcttgaggtttttatagaaacaatatgcctcagtttactcatctatataatgactatatcgatagtcatctactttataaaatatatattttataatgtaatactttataatatatatttgatatatattttaaaatgtctttattatattttataaagtataaataatataaaataatatctatagttgttgacttataaaaataaagattaaatgaacaaaaatatgtgaagcactagtttactacctagaaaatggtacattctaaatatcttcatgattgtaataaataaatgtatccttatatgttattttattaataataaacaaaaatttatttttagaataatgaatataattatttttatttttagaataaataataatgaataataatattattattcattcttatacacctttgaaaaatcatagggtaaaatgattgaaattctgtgtatagcatctcagcagatgagatctataagaaagaaccattgcacccccatttacttaaatcagttatagtttaagttgtttgaaaaaagtcatttattggaatcaccacatgacatcaatcaagagcaaagtgtgtagaatactgtcaagtttttctccaagaatttatttctgttttcaatttgcaactcactgaagcattgaacattttatgagctctacagctaacaatgcctgggaatttaaatattttccatggaatatgattacttcaaatgaaaaaaaagaagcagaaatgataatgaataatttaccatttatatatggtacaaagtagaatctttaaaaataaagacacaaacagcaacaaccacaaaaacctcaattgtttctgcttttgttctatttttagtgaacttaaaattttaagagaaagtctttctccttgtttttaacacgtgtagagagaggtgtggaatattgtaaagctttttatctgactcggcctgagtctcactagatgaagactcatcgagtttagtaggccgaatagttttttctaaaagatatgtgacacgttaatccttggaatctttgaatataatgacacgttaaacagtgaatattaccttatatggcaatgcttgtgattaagttaaggactttaagggaaggggcttattctgaaatatactcacgggtctttaattcaatgacaaatgtttttttttttttttttttttgagatggagtcttgttctttcgcccaggctggaggagtgcagtggtgcaatctctgctcactgcaacctctgcctcccaggttcaagcaactctcctgcctcagcctcctgaggagtgggattacaagcgcctgccatcatgcccagataatttttatacttttattagaggaagggtttcaccatgttagccaggctggtctcaaactcctgacctcaagttattcgccctcctcggcctcccaaattgctgggattacaggcatgagccactgtgcctggcctgacaaatgttcttttaagagtgagtcagagggagacttgacacacagaagaggaggcaatgtgaccagggagcagagattggagtggtgcagcccccagaagctggggtaaaggaatgctcgcatgagtaaaggaatgctggcagcccccagaagctggaagatccacagaatggattctctctagggacctcagagcgagtgtggccccactgtatttaggacttctagcctctagaactgttttagaatacattgctgttgctgaagtcatttagtttgtgtcaatttgttgtgatagcctagggaactaatataatgaagcatggagagagagagagagagaggataaaaggtgaaaaccatgtgccaaaactaaagaaaagagatgctgacatttgtgattaaatagaataattgcactatttaagattaatcacttgagcctcggaggtggaggctgtagtgagtcatcatggtgccacggcattccagcctgcatgacagagagagactctgtcttagggaagaaaaaaaaagattaaggtggtccagaatgcacccaagcataaaatgcaaagatgatcttgccccatgtatattttagcatactacttaggtactgtttattttttaattatctcctttttacattttgacaattttaccccagtggtcaagccttgtattagaaaagacagaaagaaggaaaagaaagaaggcaggaaggaaggcaaggggaaagaaggggaaggaaaggaagtggaagggaaggggaagagaaggggaagagaaggggaagggaaggggaagggaaggggaggggaaggggaggggaaggggaggggaaggggaggggaggggaaacatgttgctttggacagaataaatgggtaagggtttctattttaattagattaagattaattagattaaacctctgaggaagtcttacttgagctgagaaactaaatatgagagggaggagtaccactgcattggttatagatggggtagaagtctacaaaagagttcattgaggaatagaatagtaaataagtgacttaataatgagtttgttgccgggcgcagtggctcaagcgtgtaatcccagcactttgggaggccgaggcgggcggatcacgaggtcaggggatcaagaccatcctggctaacacggtgaaaccccgtctctactaaacaaaatacaaaaatttagccgggcatggtggcgggagcctgcagtcccagctagtcgggaggctgaggcaggagaacggcgtgaacccgggaggcggaggttgagtgagccaagatcgcgccactacactccagcctgggcaatagagcgagactctgtctccaaaaaaaaaaaaaaaaataataataataataatgagtttgtattgttcttattttgcaaaagaatgcaagatctgggtagagaaaaggcaagagggaggacttcccagattgaatcaataatattaacagtatcaatctgccactaataattatttaagaaaagtatttttctttcagttttatttattaaatagtttctactagcctaatgttaaagtctgccaactagtaccttcaagttaatcacattcacttttgattccctcttaacacattaagatattttataactctgtgagtttaaaatctgatgcaaattcattgtggtcaggcaagatgcaagaccagtcaggcaaatacacttcccttattttttatgggtctgaaatatcttttgtcttgggagatgtattattatacaaaagatctatttggcaatttatagtttgctttttatctattcaattgttccctggtattcttagaacagaaaagcgaaccttttaagaataataacatgccaattacctttaattactctccagctctttcagttaaacaaaaaaaccctctcattttaggtttagtttgtaactgaatagaacattttatatctaaacccttaatggaaaggctttcctatttcccacaattttcttttctatttaatgtattctctaaatttaatacattatttaaaatgccatccatatacctgatcaacttgaaaagatggagaaacacacaagtaaagtttgttatctgttcacattttattctgtttccattttcataatcaaataaatgtagactgtaaaatacttatttacaaatctgtctgatttatataataaactctgaggaaactggaatgaagcagtgctacaagcaagggacagaataaagttttgtgtattaattacctgatttatactttagtccctttaagtaaaagaacgtaacaaatagaaggatagttattaatatatttggaggagaaagaaagataaaatgaaagatacaatgttcttaaaaactgagagttttatcttttttcagaagtctaaaaaatatttaaacatcttcctttatgttagcgcatatttatgttatacatttcatttacaagtaattgtatggtaaatagttacaaaaacaacaaggaaaagctttgagttaaggagctcatgattttcagtgtaaaatacatgttatttgagtaatttgggaaactgacagaagctttcttgcagtcaagaatgctgctcaaaaattaattttaaaataaaaataaaagaaaaaaaatcctgaaagcttatgtagcaaaacaagtattgtagtccattacaaaaattagccttttctgaaatcatgttaaaaagcaaaaagatcttagagcagaatttcatgtacagttcattttgggactgatcttacttccttggtaggtggtcttacttcatcctgttggagcccatcatggagagctgttttacaaatattcttagctctactacccacataaaaattcaacctatgactcctgtttctgataaagtagctatttaaattcattaagaatgtttcatcattttagtatgcaaaatgcattgttagattatgtaagtgacacatgctatcttaaaagttaataaatctcccagaagaaattagactcagatgctatatttattatggagaattaagaaatacctaaggttactgtgatcatcacttaggagttttgaatcaattatatgagaaactaaagaagaaactttgaccggaaaaaaaatgaaccaacaagaaaaaaattatataaagtcattttattggacacaaatgctaaaaattagaaaaaccatacattttactctatcaatctgttaggaaaaactatagaatatgatagtgattgcattgattctgcttagcaaattaaatgcaaaactaagatattcaccaaatataaaatatagttattttctaagaaataaaactcacacaactgccatttttagcagaatggtggcaactgccatttttagcagaaaccaaaactatttcctgttaacaagaaggaaaaaccatcagtgaacactcaagtaataatcaggggactaggatggactctcagtaagaaaccactggaatatacctggactaaatctattctaacaaaattaagtataccaaccgaatagttttgtgtgtgcatttgtttttactatatacttttataatctcaaaagtacctaaaaggaggcaaaacaagaaaggatttgtctacagaaagtaaaaataagaatgattataaaatattgttaaagaaaagacactgcacagaatagtcatggagatttctgtactaatcaccttgatcataatgaataatcactgaatttcactggcctattttcctccacaagattctatgttaggtaagcaactttgggtaattcaataataggaaagatgtttcttttataacatatctgatttgtacaactaattgaaatacattttatgctataaaataaaaatggtaactcttatttacacagctatttattgtgaatttgtataaagacagctcatccttagaacataatagactaggattcttggtaaagtatatattgtatatctgaaaaatgtaatagtgacaatattaaagtgttgccacttagtgctgtgttacctaaagtgtgtgacgctttctgtcagtcttatcactgacatttaaatttcagatataggtgaattcaatattgaagtgaatagagctaccgacatttgctttcctaatattcatggaagttgttgttgacctctcatagataaataagcaaataatatcttcaaaaatatatctaacttgactcaaatacttctaagtattttgtcatttgaagggatatgagcaagttgagaagaagaaatgtggagagagaaatattcatgaaaactaaatttataacattcaactattgctcaattcttagaaatttaatcactacttatattttaaagcaaaatatttttgaacttatttagaaaaatatgacttcatctctcatatgtccattcaaagttttaaacaaagtataaaaggaaattaaacagtggaggaaatgagaaaggtcacaggcattcaagaggtttcaacaaatttctggaggaatgaaaggtaattgaaggatgtgttaaaataatttctattattatctttatagatttagtgtccagtaaaccttttataaacaatccaacttgctgttttgtgttcttgaactttatttaaactgaattatattgtacatatccttttgtgacttaatcataccactgcatattaagtttgtgagagtaagccacattaacatatctaaataaagttatctattttttttctaaagtgtagtattccactgtatgaatctaccacattctactgttgtttaacttttgcattgcttatagtacttaactgagcctgtaaatattttggattacatttcttaatggccaaccatgtacatacaaaataaggagtgaaagccaattgctgattagaatatatggtcatcttcaatattactgggtaatacaagactctttttaaaacggatataatttccatttccaggaaagcatatgaaattattattgctctatatgtttgccagaagtctgtcttgtcagaccgtttttggtcaatctcttgtataagtaataatgtacatataaaacattttcatttgcatttttgtgttaaaaataagttaaagtgattctaaataggtatggtggacacttacattgtacattttataaagcacatgtgcaagccattttctttgttttactgtcgggttttctgtaatttttgcctggctttacatttaaatattgattgccaaggaattgattgttaaatattatataaggtaaagaatcactttaattattttccatatgtatagccagctttctcactctcatttattggcaaatttatttttcaccactgatctataatactagctttcttacatatcatgggttcttatattttccttactgtagtctacctattccatttcattgattatttattactttgttaataccacattgcattaattcttatatttcctgtaatatatttttccttcctcaataaattattaactgaattttaatatttttagagtttacataaattctagaattagcttgtcaatatctaaatcaaaccttactgggttttactttggatgcactagttacaaagattaattttggggagaagtgatttcattaaagtctttcaattcaagaatatatttatgtcaatgttatgtctatgtttatttgaactttatttaaactgagttatactgtacgtattcttttgtgacttaatcatgccactaaatactatgtttgtgagagtaagccacattgacacatctaaataaagttctctacttatttgaaatgcatttcaatattgcataatacgtttgtgtcaaagcatcttgctaaaagctcatattcattagtataatgtatcttagaatcattttgaattttctgtgtacttagtgtcatcggtaacatagtaatctgttttctctttcataattcttatttttttaatatttacaatcctatcccagtgtctaagacctgcaaaaggataaataaaattgcttgtaccatctatgtttattttgttcccaatcacaaaggaaatatttgaacattccattgttaagtgttataatttcaatagaacttttgaaaacaaatgttatcagttaaactagattctcttttaatttcgggttgttaaaatgtatgactttttaagaaaataaaattaaatatgcttataatattgttaagttatttgttgtggtgtatcatattaattgatacctttacatgaggccattattgcttcccagggtttcttagaataaacattggctgtgatgtcttacattttaatgcattgcttatttctgcatggaacttttttaagttttccttcaatattttcataaattacattggtgtttaatttactttccctttactatccttgtcaggttataatatcagagtcataatagcataataaaataaaatagagtatgttctttcctgtttcatgctcagaaagaattgtatgtaagattggaattattgttttgtttcatgtttgaaacaacttgccagtaaagtcatcatggcttgaaattatctttatgatatgatttctgactactgattacatgcatttgttgtagcacaattcagatttttcttttcactttaggttacttttggaaaaatgcatgtttcaagtaattgtacacattttacatatatttccaaatttattgaattaaacgttttcatactatactaatttaacttcttgatatttgtattatttataacaaaactcaataaactgtggcaaataagccagacagtatttataaataaagtattactggaacactgtcatgctcattcattgacatactgtcaatttatgccacaacaatagaattgattagttgcaacaaaccatatagcccaaaaacctaaaataattaccaacagatcctttccaaaaaacaaaaaaaattcttgacacctgatgtataattatttcctattttgattcctgagatggcatacttgtttcttctcttaattttatcaagccatttctccagagttttgttattgtatggctcctacaacaactaacaaacttttggccatatttcttgacttttctttccctgtattcttaatcactatgcatgtatttattatttccttttatttctgttgatatttctaacttctaccaataaattcaaaacattttaaaaattaatttgttgtcctcataaaataagaatttaaggttctacattttcctctaaaatgacacattttataatgtagtatacattttttaattaaaaatattttataatttccattatgatttgctcttgggtgttgagttactaagaagtatatttctgaggtttttcttcaatatgactgactatagatatttgactctagttattctcagaaagagaaagcaaagttatggataaataatcgttaattccaatatctatatagacggaagtgtgctagagcaccacaagaagaaatttgaacacagaaaaataaggaagcaagaacccagcagacattatactctgagggacttgatgttccatggaaaagcataggtgggggtgtcttttgctcttctcacctctgcggcagactgcttgtttctgaactgttggagagccctccattctcacaagcccaagcactggtgtgggccgcaatcttggaacaaattgaggacagagaacaaggctactatttcctgcagtgccacttgcccttcacccagccccaagatgaggtggtgggcaccatactggatatgcctctgtggtggacttctatactgcctttgagtgagagagaggcttgccccatccccttgccggcttccttctccgtccctgcgtcgagctgtggctagatttctccatgagggcagagggcagggcaagaggcgtgagaagcatcttctggaaggtctgcgggcaccctcctgcgggtggacaatgagcgcctgggaggccgttgtccttggttggggagcggtcgtctggatctagcctagcaaagaggctgctccggatggggaggaaatgaaaacccctgcagctccgacgcagatgcccacgttgcccaggccttcacagacccccaagccggaaccgccgggaaaacgattgccaaccggccacaacacccaggcagagacgcggggagaggctgaccagaagaaaggccgacgtgcaagaaacccagcctccggcgcacagggaacatgtgtcccaaggcgcacgcacacacagacggacagagacagaaagagagggcgacggaaagagcgagaagggagagagggagagagagagagagagacttaagagagagacggtagtgggcacacagacacgcacgcgcgcgcgcgcgcgcacacacacgcagacacacacacacacacacacacccataacggacacagacatacagcaggtaacacccacccccaggcagcccctgaagctgccgggttctggtctccgcgactacgagccaccggtgagacagcagcccacgcgcacacagggagacctgtcctcgacatcacaagggcgccacttttggggagactcacccgcacaccgtccgcgcacgcctgaggctgggatcccgcgctgcctccccggcgatctgtctgagttttcttcctcctggggtttcttcctgctggtggaccctccgcgaatcccggcctccggagaccgtcctggtaactgccctggccagggctggtctcagccccgactctgacgcacgatcacacagggctcctacttcgccaagtctcaaggacccatccccgggcaatggtggcggtcactgtgaccaaagcggcggctcgggcctcgcgcatgcgcactggcgaggccgactcacccgccccacccccccttactcggcagagtcaggctgcggaccttttaaaaaatggcggcgacgcggcggctgcggggactggggcggcggtgctggaggttgcggcggcggctgcggcgcagcccggggcggcgggtgggaagaggactaccagaggggcctgcgggagacccagggtcggacccataggagtcctgtcgtcaggacctccttgatcggtcttctgcttgggttctcggtgaaggaggagcttcggggtgtcggctgggctgcgcggactcctcttgggatccgatgatggatcccacccggtgatcgggaatggggttacaatgcagtgaggcggaaaggctctcgccggggcacagaaagatccccagggccacaaggcgtgctgtcgcctgcaaaggcactgacccacgagcccactgcctccctccttcctgggtggagcaggggcctgccttcatctccaaggcccgggggctccggcatctcgacgcggcttccggcgacacgggcaaagagagacagaggctagtccgagccggagccagtgtgaccacacgtggcactgacgtcccccaagagcacatgcagtgagcctgtgtctctgaggccgtagtgggcgacgatgagacggacagtgatgtccaggcctgcgcccgggggccactggagacctgcccctcaaagcggaggaaacgccaagcgcacctgaaaacctgcgagacagggcctgtacacgagtccaatactcctacttcgccaagtctcagggacccatcccccagcaacggtggcggcgcagagaagagcacggcgccggcgcaggtgcagagagacaggaggctgatggggggaagttgaggcacctggggcagagaaaaaaatgcatcgccaagcggtttctgggtcatctactgacgaaaatgtcttcccatcagcccttgcgctggtccccagggaccctggcatccgtcgttggcgcccagggtgcgcgtcgggccactaggggtaccccaactcggacagaaggcccatgagttgaatttgaagtttgtgggaatagaggtgaggcaccaggggcagaaaaaaaacaggagacctcgcctcagacaagcggggcctgggtcccccatggatgaaagtgccttcccattatgctgtaccctgggcagagtggacagtgacgaccctggttcgagcccagggtgcgcttcgggaccgcttgcggtaccagaaagcgaacaaatggtccatgagcggaaggtgaggcacctgaagcagagaaagtaaagaaacgcgccgccgagaagcagtgcctgggtccctcacggaggaaattgtcttctccttagcccgttcgcttggcactgaggtccctggcgtccctggtttgatcccagggtacgcctcgggccactagtgttagcccaaggtgggcagaaagcccataaggggaaggcgaggcacctggggcagagaaaaaaaaaaacttcgctgcagagaagagcggcctgattccccacggacgaaagtgtcttcccatcagtccctgcactgggacccggggaccctggtgtccctggttcgagctcagggtgtgcctcagccgctacgtgcaccccaaggggagctttgggagcacaaagcccatgagggaaggtgagttttgagggaggagtggtgaggcacctgtcacagaaaaagaaaaaaaaacaacccgcgccacggagaagcagggcctgggtcccccacgatgaaaatgccttcccatcagctcctgctctgggccctgtggaccctggagaccctggttcaagccacgggtgggcctcgagcccgctaggggtacccccgtgcgcctctctgcgcctgcgccggcgccctgtgcctttgcgagggcggagctgccttctcctcagcacagacccggagagcattgccagggcggagctgagttctcctctgcacagacttcggagatacagcgaagcggagcatgttctcctcagcacagacccgggcgggcgggccaggggcaccgcgagggcggagctgcgttctgctcagcacacacccgggagacaccgcgaaggcagagcagcgttctcagcacagaccttgtgggcactgcctcgctttgggactactcggagccgcatcaatggtgaataaaatccttcctgtttgcagcccttaataatcagggtcagagaccagttagaagggttcagtgtggaaaacgggaaaccaaaagcccctctgaatcctacccaccgaggttctccccagccaaggcgaggcggccgcagtgcgagatccacaccgcagcctcggaagacaagcgggcagaaatcccatgaggggcagttgaggtttgaggaaggcgaggtgaggcacctgtggcagaaaaaaaaaaaaaaccgcaccacggagaagcagagcctgggtccccaacggacaaaagtgtcttcccatcagcccttgcgctgggcccaggtgaccctggcattcctggttcgagaccagggtgcgcttcaggccgctaggggtgcccaaaagcgggcagaaggcccatgaggggaaggtgatgcacctggggcagagaaaaaaaaaaaaaaaaaaaccgcgccgcctataagcggggcctggctcccccacagaagaaactgtcctcacatcagcgcttgcgctgcgccccagggaccctggtatccctggctcgagcccagcgtgcgcctcggcctgctaggggtaccccaaggcagacagaaggcccatgagggaaaggtgagacacctggggcagagaaaaaaataaaaaaactgcgccgcccagaagtggggcctgggtcccccacagacgaacgtccctacccatcagccctgaactgggccccggagaccctagcgtccctggctcgaaaccagggtgagcttcgggcccgctagtggtacctcaaggcgggcagaaagcccatgaggggaaggtgaggcacctggggaaaagcgaaaaaaacaaaaacaaaaacgtcgcagagaagcagagcctgggtccccgaggaagaaagtgtcttcgcatcagcccttgcgctgggcctcggggaccctggtgtcccagtttcgaacccagggtgtgcgtctggccactaggggtaccccaagtcggacagacggcccatgaggggaaggtgaggtttgagggaggagacgtgaggcaactgtggcaggaaaaaaaaaaaaaaaaaaaacacgccgcggagaagcggggcctgggtccccaacggacgaaagtgacttcccatcagcccctgcgctgggccccatggacactggcgaccctggttagagcccagggtgcgcctcgtgcccaataggggtatcccaaagcgggcagaatgctcattaggggaaggtgagacacctggggcagagaaaaaaaaaaaccgcgccgcaaagaagcgggacctgggtcccccacggatgaaagtgtcttcccatcagcccctgccctgggccccatggaccctggcaaccctggttcgagccccaggtgtgcttcgcgcccgctagggttacccagaagccggcagaaggcccatgagaggaaggtaagacacctggggcaaaggaaaaaaaaaaccgcgcttgcagaaaagcggggcctggctcctccacggacgaaggtgccttcccatcagcccctgcgctgggccctggggaacctggtgtccctggctggaaaccagggtgcaccttggacccgctaggggtaccccaaggagagcagaaagcccatgaggggaaggtgaggcacctgcggcagagaaagaagaaaaaccgcgcagcggagaagcggggcctgggtcccccactgacgaaagtgtctttccgtcagcccttgagctgggtcccgaggacgctgacatccctggttcgagcccacgctgcgcctcaggctgctacgagtaccccaaggaggaaagaaggcccaaaagtttcagctgaggtttgaggcaggagagatgaggcacctgtggcagaaaaaaaaaaaaaaaaaaaaaaaaacgcgcagcggagaactggtgcctgggtctcccagggacgaaagtgccttcccatcagccactgcgcttggccccatggaacctggcctccatggttcgagcccagggtgcgcctcgggccgctaggggtaccccaaagtgtgcagaaggcccatgaggggaaggtgaggcacctggggcagagaaaaaaaacaacaaaaaacctcgccgcggagaagcggggactgggtccccccaacggacgaaagtgtcttcccatcagcccttgcgctgggccacagggaccctggcttccctggttcgagcccacagtgcacctcgggccgctaggtgtaccccaaggcagacagaaggcccatgaggggaaggtgaggtttgagggaggagcggtgaggcacctgtggcagaaaaaaaaaacgccccacggagaagcagggcatgggtcccccacggacgaaggtgccttcccatcaggccctgcgctgagccccgtggaccctggcgaccttggctcaaacccagggtgcgcctcgggccgttaggggtaccccgaggcgggcagaaagcccatgaggggaagttgaggtttgagggaggagaggtgaggcacctgtggcagacaaaaaaaaaaaaaaaaaaaaaaaaccgcaccgcagagaagcggggcctgggtccgccacggacgaaagtgtcttcccatcagcccttgcgctgcgccccggggaccctgacgaccctgattcgagccgagggtgcgcctcggtccactaggggtaccccaaagcaggcagatggctcatgaggggaaggtgaggtacctggggcagccaaaagaaaaaaaaaactgcgccgcggagaagcggtgcctgggtcccccacggacgaaagtgtcttcctatcagcccttgcactgggccccgggaaccctggcgtccctggttcgaccccatggttcgcctcgggccgctaggggtaccccaaggtgggcagaaggcccatgaggcgaaggtgaggtttgagggaggagaggtgaggcacctatggcagaaaaaataaaaacgcgccacggagaaggggggcctgggtcccccacggacgaaagtgctttaccattagcccctgcgcttggccccgtgcaccctggcgaccctggttcgaacccagtgtgcgcctcgggccgctagccgtaccccaaagtgggcagaagcccatgaggggaaggtgaggcacctggggcggagaaaaaaggaaaaaacctcgccacggagaagggaggcctgggttccccacgaaagaaagtgccttcccatcagacccggtgctaggccccagggaccctggcatccctggttcgagcccagggtgcgccttgggccgctgggggtaccccaaggcggacagaaagcccatgaggggaaggtgaggcacctgtggcagaaaaaaaaaaaaaccgcgccgcagtgaagctgggcctgtgtcccccactgacgaaagtgccttcccatcaggccttgcgctggacctcgcggacactggggaccctggttcgagcccagggtgcgccttgggcccgctaggggtacccagaagcgggcagaaggcccatgaggggtaggtgaggcacctgaggcagagaaaaaaaaaaactgtgccgcggagaagcggggcctgggtaccccacggaagaaagtgtcttcccatcagcccctgagctgggcccaggggaccctggcatccctggttcaagaccagggtgcgcttcgggcctcttggggtaccccatggcgggcagaaagcctatgaggggaaggtgaggtttgagggaggagaggtatggcacctgtggcataaaagaaaaaaaaaaccgcgccacacccttgcgctgagccccagggaccctggcacccctggttcgagtccagtgtgttcctagggcggctaggggtaccgcaagtcggacagaaggcccatgaggggaagtgaggtttcaggaagtagaggtgaggcacctgtggcaggtgtccatctgtaaactgtttatccatgtgagccctgatgtccaccaggggctggatgtccccctggggctagatgttcgcctggagcctggtgcccacctggggcctgatatccacgagaggcttagttatccacctatggccatctggagccagaggcccacctgaggtctggtgtacacctaaggcctgatctctacctggggcttgggtgttcatgtggggcctgatgtccacctaagaccatgtgttcacctggagcctgggtgaccatctgggttatgatgttcagctggggcccagagttcagctggggactgggtcaaccttctgcctgatgcacacctggggactaggtacccacctgggctccagtgttcactggggcctgctatctacctggggccttgtatttacctaggaccagtgcatccatctggggtctgagtgccctcatggagcctggagttttcctggggactggggtctgccttaggcttaagtgtacatctgtggcctcgtgtccaccttgggacagatgtccacctggggacggatattcagtaggggcctgagtgtccacctggtttgtgatgtctacctggggcctggtgttcatctgaggtgtgatacccacctggggcctggacatttgcctggaacctgatgtacagctggtgcctgaagttcatctatgcctggtgtctccctggggccaggtagtcaacacagggcctgaagaccttctagagttcagtgttcacctggggtccgaagtccacctagggcttgggtgtccaaatagggcctggtgtcagcttgagatttgtgtatttacctagggcctggttgtccacttggggcttgattttttacttggtttttgtgttaatctggggtctagtgtccacctggggcctgggtatccacctagggactattgtccagctggagactaatgactacctatggcctggtaatcacctaaggctttgtttcacttaggtacttggtgccaaactgttgcctgctgttcacctggggtatggtgtccacctggggtctggatgtcagcctggggcttgttgtatacctgtatcttagatatccagataagggtctgttttctgcttaggtgcagcagtccatctggtgcttgagtgtcaacctaaggcttgatgtctatgttggacctagggttcacctgaggcctgatatccacctggggcctcaatgtccaaatggggcctgatgcccatctgggccctgggtgtccacctgcagcatggatgtccactgatactttatgtccaccaggggcctaatgtccacctaaaacctggagttcacctggggtctgatgttcagctgaagaccggatgtccacctggagccgaggaatccacccagggactggtgttgaactggggcctgatgaccacccggggacaaggtacacaccaggcttgatgtccacctgtcaccagatgtccacctgagtcctgatgtccatcttgatcctgagtgtccacattgggcctgatgtccagctggggcctagatacccactgggggcttcctgttaacctggggactggtgtcattctggggcctaatgaccacctgggttgtattattcacctagggcctggtgtccacttggggcttgagtgtaaccttggacctggcacccacataggattgggtatcagactggccccttggtgtccagttaagacatcatgtgaacctggctcctgagtgtccacttggggccaaatgactactgggggcctgaatgtcaacctagaatctgaggtttactaggggcctaggtatccacctggggcctaatgtccacccgagcctgggtgtcaacctggggcctgatgtaaacctctagttcagtatccacctggggccagatgtcttcctagagacttatattcacttttgacctgatgtccacctggggacttgctatccatccatggtctgatattcacctggagacagatgttcaactgtggccagaagtgctcctggggtctgggcttccacctggagcctgatgtttagctggggctagagttcacatggagaatgatgtccacctgaagtttgatgtttacctggggcctgatacctacctggtgcccaagtattctcatgtgcctaacgtccactagttggcctggtgttcatctgagggcttggtgtcaaccagtggctttatgtacacctggattctagtgtcctcctggggtcttatgcctaccaggagtctggtgtacctctggggtctagtatccacctggagtctgggcgtccacctggagcctaatgttgaggttagactgagtgtcagcctgaggcctgatgtctactagggcataggtattcacctggggcttgttgtttacctggggactaatgtcaaccttgagcctaggtatccacctggggaatagtgtccagttgcagccagatgtccacctatggcctgaagcatggttgttatcctaaggccttgtattagtccattttcacagttataaaaaactacctgatattgggcaacttatgaggaaaagaggtttaactgacccacagttcttcaggcttaatagggagcatgactgggcgggctcaggacacttacaatcatgatgtaaagccaagaggaagcaagccctttttaccatgtgggaggaggagggagacagaatggggatgtgctacacactttcaaataaccaggtctcgtaagaactctatcacgagaacaccaagtgggaagtctgcccccatgattcaatcaccattcaccaggcccattcttcaacccgtggggattacaattcaacatgagatttgggtggagacatagagccaatatcaggcctgatgcccgcctggagtcatgtctacctgaggccttatgtagacatgaggcctgggcattcacctaggacctcatgttaagataggggctggagttcttttggtgcctagtgtatacctggggcccagatgtataactagagcctgatgtttcagatggaaacctgggccccaggtgctcatcagatcccaggtgaaaactcaggcttcaggtgcacatcagactccaagtggacacataggccctaggttgataccaagatttcaggtagactctgggtcccagaaaaacaccctgccctaggtggacagctgaacctgagtagacatcaggccccagattgacatctggcctcaggtagattccttggcccaaggtgaatactcagtctccagccctaggggaattcagtcttaggtgattaaggactggcgttcctctggggcctcatgtctacctgggccctgggagtgcacatggagccagatgtctataaagggcctgagtgtccactagggcctgaggttcaccaggagcatagacatccacctaggacctcatgtccacctaaaacctggtgttcacctggggcctgggtgacaacctgggatctgatgttcacctgaggcccagagttcagctggtgcctatgtcagcctggcacctgatgcacacaagaggactaggtgcccacctgaggactggtgttcatggggaactggtgttcagctgtggcttgatgagcaactgggtcctggtgtcctcctggcaactgatgtccacctgggactgcatgcttacctagggcctggtgttcccctggggcctggtgtgcccctgagatctgggtccacctgggcctagtatccacttggggcctcatatccatctggaacatcatgtccacttggggccttgtagttacctagggactgggtgtccttctggcacttgagtgtcctcctggggcctggggttctcctggggcctgggtgtacatctctggcctgatgtccaccttgggtggatgtccacctggggacagatgttcgcttgtggcttgagtgtccatctcgtgtctaatgtctacctggggcctggtgtttgcctgaggccttatatccacctggggcctgggcatccatttgaggcctgatgtctacctaagacccggtgtttaactggggcacagatttcttcctggagcccgacgttcatctggagcctgaagttcacctgtgcctgttgtctacctgaggcctatgtgtcaacctagggcctgatgaccaccctgagttcagtgttcacctggggcctgacatctgcctggagtctgggtgtccacatagggcctgatgttggcttgggaccaaagtatttacctagggcctgggtgtctacttacagcctgacttctacatggttcattgtgtcaacctggggcctgatgtccacttagggcctaggtaagctccttatgactaaagtccacatgggggctgaaaccatctcagaccttgaacctagggcttagtgtcgacctgagacctggtgaccccctggggtcaaggtatccaccttgggcctgatgaccaactggggtttaaggatctacctagagactggtgtcaacctggaacctgatgtccacttggggtctggtgtacaccttgggcctgatgcccaccttggcacaggtgtacactttgggcctagtgtgcacctgaagcctggctgtcaacctgggtcttgatgcacacctttagtcaagtgttaaactggggcctgatgaaatactggagcctgatttacacctgtgtactgggtctccacctggggcctgatgtccacctgcagccagatatccacctggcaccagatgtctttgaggaatctgggtgtccaccttgaaaatgatgtattccaagagactaggcatgcacattgggcctggggtccacctgggtcctgatgtctacctgaggctggtattgaactggggcctgtgtgttcacttggagcctgatgttcatttggaacctggtgttcacctaggacatgggtatccacctggatcctgattttcaagtggggagtggatatagacctgggaactgatggccacctatgctataagtaacccaaccacctggggcctggtgttcacctgtggcctgatatccacctggtacctgtgtgtcaatctagtgcctggtgtccacttgaggactaggcagacacctggggcctggtgttcatcttgcacccagtgtccacctggaccctgtgtatcaacctgtggcctaggtggccacttggagctttacgtgcacctggggcctgagaggttcctaggatctgatgaccactggggcccaggtatccacctgggatatcaggcttcaagtgtacacccaggctccatgtggacaccaggccaggagaacgccagcccttatctgaacatcaggtcctagatggactcccaggctccatgtgtacatcaggccccaggtatacacgggactccaggtggacaccagcactcaattggatacacaccctgaaggtggataccaggccccacgtgaattcctacactccaggtgaacatcaggtcccaagtggatacctggaccccaggtggataccagtctctaaattaataccaggcctcagatggtccttaggagccatgtgggcattcgtcatcaggaagttacctaggcccaaagtggacatcaggccccatgttgacacaagatctagttggaagtcaggcaccaggtggacacccaggccctaggtaaatacttaggtcccaagttgacagcaggccctatgtgaacactcagaactcaggtggacatcaggcctcaggtggacatctgagttcatctggaacctcgtgttacaggccccatgtaaacaccaggccttaggtggatacccaatctctaggtggacatcagagctcagattgacacaaagactccagtagacataatgtaccaatgaatatccaggcacccggtaaatacccaggccccagattgacaccacggtctatgtggacacacaggccccgggtagtaaacaggcccaaggtggacactggactggacatcaggtcctaggttgacaaccatgctccaagttgacaccaggccccaagcgaacatctggccccagctggacactagtcccctggtgaatacctagtctcaaggttgacatcagaccctatgtgaacactagaccccagataaacacttataccctaagtggacatcaggcctcaggtggttacccagtcccaaggtgaacatcaggaccccgatggcaccagttatcaagtggattcctaggccccaggtgaatatcaagccctaggtggataccgagccccaggtggatacctggatcctggtagacatcaggtcccaagaggacactagaacccaggagtacattaggccacaggttaacacgaaggccccagatgaataccaggccaacttgtggacatcaggcctgagaagggtcctgtggacatcaggcctgagaagggtccaggtggatatcaggccccaggtgaacatccagcactcagatgaacattaagcttcaggtaggcatcatgcctcaggtgaactccaggccccagctgaacatcaggccccaggtggatgcccagaatccgggtgcacatctggccacagttggacattcaaccccaggtgaccatcaggccatgggtgaatacacggtttccaggtagacatcagatcaaaggggaacatcagtcccccagtggacatcaggcccaaggtggacactcaactagaggtttacatcaggccacatgttgacacctagtcccaggtggacatcaggccccagctagatagatacctagtcttccagtgaatttcagacaccaggttgacattcaggcccccagtggtcatctggcctcatgcgaacactcagaccccaggtgcaaatgatgtctcaactggataccaaaccccttgtttgataaccaaggcccaggtggacaccatgtccaaggctgacactcaagccctaagtgaataccaaactctaggtgaataattcaacccaggtggtctttaggactcagctggataccagtccccaggttaacacaaggcccccagtgggcacctaggcaccagctggacatcaggccctatgtaaatacccgggtctcaggtgaacaccatgccccaggtggacatcaggcactaggtgaacacggggccacaggtggacatctagcccctgggcaacatccagccccaggcggacataaccatttccatggataaaccattcccaggtggatatcaggcctcaagaggatggcagtcaccaggtagacatcaggcctcagatagacaccaaggtcccagatgtacagcaggccccaactgaaccccagactcatgtggacatcaggccacaggtagacaccaagccttaggtagatacctaacttcaggtagtcatcagacccaaggtggacacccagtccccaggtggacagtcaggccccaggcacacatcaggccttaagtggacacccaggccccaggttgatatccagttcccaggcgatcaccaagccccaggtagacaccaggccgtaggtgagcaacaggatgcagtaggtcatcaggccacagctggataccagtccccggtgatcacaaggccccagtgggacatagatctaaggcagacatcaggccccaggtggacatacagatctgaggtggaattcaccctgagggggacattcggccccaggtacgcatcaggcctcagctgaataaccagtccccaggtggacattaacccacaggtcaaccacagtccccaggttgatatctggtccccaggtggctactcaatctgcagggtaacattaggcccctgtaggatcccaggccccaagtggattcctaggcccctggtgaacatcaggtgcaggtgtccaagtaggccctgggtggacataactgtgtacaggtaaggagttgacctgtggggaggatgagcagtcagcagcccactggggtcctgagtaggtcttctggaaggaggaggctgaggggatggaaccttaaagaagcaacctcacttccttggcaacagaccctaacagaacttagaattctggtaaccaggccaggcacggtggctcacacctgtaatcccagcactttgggaggctgaggcaggaggatcatgaaaccaggagatcgagaccagcctgaacaacatggtaaaaccacatgtctactaaaaatgcaaaaaacaaacaaggtcaggagatcgagaccatcctggctaacacagtgaaaccccgtctctactaaaaatgcaaaaattagccaggcgtagtggtgggcgcctatagtcccagctactcgggagtctgaggcaggagaaaggcatgaacccaggacacggagcttgcagtgagcccagatcacgccactgcagtccatccagcctgggtgacagagcgagactctgtctcaaaacaaacaaacaaacaaaaaacaaacacaaaaaaactagccaggtgttgtggtgcgtgtctcgtgcctgtaatcccagctactcaggagactgaggcaggagaattgattgaacccaataggcggaagttgcagcgagccgagatcatgccactgcactccaccctggccaacagaatgagacaatgtctcaaaaaaaaaaaaaaaaaaaaaaaagaatcccgataaccaggcaccaggcacccacatcctagagttagacccatagccagctcacttggtgggagatgctcaagagagcaagatgttcttgtgctgcatccccacatctcaagtctcctgcttcaggaatggcaggagtgagagcctttcttttccaacgatgcccttgtaggctcatccctcaccccagatgtctctggccatttgacagaaggcccccccaggtaccacaggacaggagtcaccaggtagacatcaggccccagatggagctaccaggccaggcctcaccagtgatcccaccagggccacatctgcacattgtccttgtccagctggagcctctggagctcattgagacacaggcacatggtgaggtcacctgcagtctggaagtctttccagggacaatgttttcaggctgaaattcctttaaattcagtgaggttgttttcatgtttggaaattccagtggaaagtgagtgatattggtgacctctctcctttttcagctcctgcttcaggtgcagaaacacagctatttccagtgccagctgttgagccagtgccagcaccaggggcagagccccttccagggacagcgctggagctagaggaacctccagagccttcctgccgctgccctgggactgcacaggaccagcccagtgagaagctgcctgacttcatggcacctcctgtagagccaccggcctcagccctggagctgaaagtgtggctggagctagaggtggcagagagggggtgaccagcacagctccagccagcagctcccacactgctcccagtcctgggcacagtggaagctatggaggcagagaccagggtgtgcaacctgggctcctctgcctcactggagagggacttctctcattcagcagagcagcagccctgctgctgaaggccctgctgctactgctgctgggggtgtttgcctgcctgcaggaggtgctggagagcaagaaaaggagcctgtgagcaggggttccagcaggtcctccggctcccagaggtgacctcctcctccaggaatggaggtttgccctcagctgggcatctgggccatttgcctctaatgtgctgcccaggatggcctcttcttgacaggtggacaggggttgagggggccagggggcatctccaaaggaagctcttaaactcagcagcagcactccagaatctccatgcctgcacctgcccaaggatttattcatagcttaactaagaatttcaaatttctaccataacactgaaataaagtttgactttttgaaacttctatgacttctttcactccctaatattgtagatggtggttttgaggtgacgttgaaaacctctgatagttgtgtgttttgttgtggttctttgggtgactaaattaccatctgatcaagtgatattgaaaacccttcaggtatggcttttagaagactttgacctatttttgcttgtgttgactctccctccagctttgtggaaagagggatcatgtaggttcaattctcaggcagatcagtcaccttttgccatcaaagttttagcatccatttcgaaaatttggtgtacaagttgatattttggtgtttttagctaatctggggtcaaaacagaatgccatagatgaggaagcttataaacaaatttgtttctctcagttctggagatggcaaaattcaaggtcaagtggttagcagattctgtgtctggtgtgggcttgctttgtggttcatagccatgtttctaccatgtcctcacatgacagaagagatgagggagctctctatggtgccttcaataggggctactaatcccactcttgtggtccctgccttcatgatctaatcattccccaaggccctacctccaaatatcatcacatagggaattagatttcaacacttgaatttgagagggacaataacatttggtctatagcatcaggttacccagagccttatgcattcggaggaaatccaaaatcttctgtaagtatttgctggtcccctctgggcttagggaaatctttaattgcagctcttgattcagcttggtccaagccgaaattctacgtttgcctgggtaacttgttcatgggacagagggaagtatagaggcaactgaccatttggagttttaggacaattgatggaagagggcttggcatctggatgagaagtggagggagaatagaacaaaggcacagaaggagagagcacagtgagaaaggggaagagggacatctggacataagggccaactggagggcagggaaggtaattttccttgcattttaaactcagaccacatatcacatcagaatcacctcagggagacgttttcaatgcatattcctgggtttcttctcttggaattttttattaaatcttgagttgtgctgatttatccatatttatcataagaattttggataattcttactttgagaggcccaggcagtggatcacttgaggtcaggaattcaaaaccagcctggccaacatggtgaaacctcatctctactaaaaatacaaaaattagccaggcatggtggtacatgcctgtagtcccagctacttgggaggctgaggcaggagaatcacttgaatcagggaggcagagatgacagtgagctgagatcacaccactgcactccagcctgggcaacagtaagactccatctcaaaaaaaaaaaaaaaaaaaaaaaaagaattgtggataattctgatgcaattagaaaacaaagcagagcttgacaaccactgggttgggacgtatatcaggaagacatttgattatgtaaaataactgcaaaacaaactgaaggggaattattttaaaatgcttgaatataattatataattcaactcttcttatgtatgtagtttgaccacatatttgatgtctgctatactaagattggaaatgtgtagaagtttttttaaaaaatcaggtagaagcacagaaaaaaggagttggagagaaaagaaaactagctattgtctggtaacaagagaagagaagggaaacgaagtagcatatttttgttcattgatggcatctaaattatgatcccaaatatttttttcctaagaaatccaataatacaagtattcagagtggagtaccaacactgatttactgggaaagagaagtgtactctgttttgctacacaatgttgagggagaaggaaaggaaaattatttgagtaaacaagtaagagactggtcctcagggaagctgtctgcctgaaaaatcacaactactgcacctacagataagccctgaacagataagcatgcagggtccagcacagatgccttctgttctttgtgtatttggcaagctcccaggtaaaattttcctccctttttcaggcatatacttggcggtctctgtgggaacttgcgcagggaggaggggggcttacctaaaacaaacccacagttacagaaacaagagaagcccactttgtgcttgactagagacatacccacagctggatatataaagggaattgtgccgacagttttatatatagctgagaggagtttcttataaaagctttttgattcaactgtaaaaacggcaatccacttggacgcccttgtctgctgcagagagcttcctccttttgcttgttaaactttcactcccacctcacttgtgtgtccccgtcccttaatcatcttggtggtgagatgaagaacgccaggtgatacctcacaagagagactgctacgttgtggtgcattggcgagactgcaactttaagaagtgtgacttttattgctgctgaattattttatctcctacccaattgaaaataaaggatataaagtgcttaggttgaacacaaagtcctctgctctaggtaacatcttcagcagccacattagcagaggcatgggtggtaatggtggagtagatgtctctttgcttctgacagggtgtctgcttatgtgttaaacaaaatagtatggtatatatttcattaagaaatctgctaaaaaatgaagtaaaacaggttcatgttcttaagaggcacaggatttgctacggcagcaagaccaaaaggcttaagtaacaaaaatgtgcatagtagttacaaacattttcatctaaacaaaacaatgtgagcatctgcatatgacaataacttatgcaaaaaaatatttttaactgagattgaaatcattttatacataacaaatgttatcactgtattctcaggtaatatattgtttgtatatagatgttataaataataacttatttaagttattcatcatttatacaacaattaattctttggaatctacaaaatgctggttttgttctaggcactgaatgtacaaattgatttaaaatatgtgttcttagagtgtggtagattaaaaaatacaaaataggccgggcacagtggctcacacctgtaatcccagcactttgggagtccaaggtaggtggatcacctgaggtcaggagttcgagaccagcctgaccaacatggtgaaaccccatctctactaaaaatacaaaattagccgagggtggtggcacaagcctgtagtcccagctactcgggaggcagaggcaggacaatcgcttgaacccgggaggtggaggtggcagtgagccgagattgcaccattgcactccagcctgggcaacaagagcaaaactctgcctaatacatatacatatattatgcatagatacatatatacatatgtgtgtatatatatacatatgtgtatatataacctatatacatatgtgtgtatatataacctatatacatatgtgtgtatatataacctatatacatatgtgtgtatatataacctatatacatatgtgtgtatatataacctatatacatatgtgtgtatatataacctatatacatatgtgtgtatatataacctatatacatatgtgtgtatatataacctatatacatatgtgtgtatatataacctatatacatatgtgtgtatatataacctatatacatatgtgtgtatatataacatatacatatgtgtgtatatataacatatatacatatgtgtgtatatataacatatatacatatgtgtgtatacatatatacgtaatatataatatatgcatatgtattatatacatatatacataatatataatatatgcatatgtattatatacatacatacataatatataatatatgcatatgtataatatacatatatatctgtctaatatatatacatatatacatatattaaatatatatacatatatacatatattaaatatatatacatatatacatatattaaatatatatacatatatacatatattaaatatgtatacacatatatgttagaagttgtactgctgaaaacaagagctaccaataaaaaaatttcaggaaacctagtgtgattatttttaatagaaatggatattttaatacaggtctcttgttttttcttgtggaaataaatgacaagatggaatttctgggtgtttggtatctgaatatttaagtatagcaggtatggtcagtttttcaaaggcattttaccatcttacttgtccatcggtaactcataagatatgtggaacaacgtcctctccaacaacctctagtatcagtctttgtaaagtttgtcaattaaatgggtgtttttttgtttttgtttttctttttgagaccgtctcaccctgtcacccaggctgtagtgctgctgcgtgatcttagctcactgcagtctttgccttccaggttcaagtgattctcctgccttggcctctcaagtaactgggactacaggtgccccccaacacacccagctaatttttatatgtttagtaaagacagggtttcaccatattggccaagctgttctcaatcctgacctcagatggtccacctgtctcagcctcctaaagcgctgggattacagtcatgagccaccgcacttggctggttttctctctctctctctctctctctctactttaagttctgggataaatgtgcagaacatgcagttttgttacacaggtatacatgtgtcatggtggtttgctgcaacatgggtgtaggttttgcaggtaattattatattattaaaagataacagaatacctagctaaaaaaaaatgcgaggaggcattgatgggcacatgtttactgagcacatcctgactccagaattaaaaatccaatttatgcctctgcagtccaataaaatttttccttaagaatccagggatcagactttcatctcagcaaccactccaatatggtttctcacctactcattccaacgagctgctcatatcaaaatataagtgctatccatattgttaaattataaattgaaccataacttctcagccttcatcttaatttatatatcagcagcatttcacacagtctatctccaccttctctttgtaaaacttttttatagaattccagaacacttaacttactttccccccaccacgtttttgaaaattacccctagtccttttttgcaggtttcatctttactatttttcaaatgttagaggaccattaggctcaggaatttcacttcttatctttcttatctttgctttcttactaatttttgtgtcattaatttcctgatatttcatattacacctaaacactggacactacacccaacactccctgacttatccacgtggatgtcagttaggaatctcaaaattaatatgtctgtatggagccactgaaactccccaaatttgctcttccccattctgtttaatggcaactcccattttatagtttctcagctcaatattcttggtgtccccttttaattctgtctctgtagctctgtcactctcttcctgtatctgtctgattctctccctctctctcctctctctcttgctcactctcactcttgctctctctccctgcttcacacacacacaaacacagacagacacacacacacacacacacacattttcagatctgatgtgtatggaattcctgccagctttacctttaaagtgtaataattccaaatgttgtttccaaattcacattcccacccccaccacttggtaactatagcgcttccctcacaaggccaagtgcagagatttcttggggaaataatgagaactattatacattcttatttcaaggacccttaaaattataggattaccatatttgatactaatttaagcttctgtcattgcccttttttaaatccagtctccacacagctaccacagtgtgcaagtagaagtctcagccatatcaccacactcctgctttaatgtccctactccattgctgcttttctccttcagaagagtttaagcttaatgaagctgggcaactttacatatttttccacgagctggagatcacttggtgtaaggtaaaaatgatcagtaaatattttcaaataacagaatccatgaataatagttttgtttctttgagagtacattaacttttaaaaatcaagaaaatagattggtcaagagaattctgcttgttttgattttgttatccctcgattagattaactgtgttagtataaatgtcagtgtggaaagctataagcatttcctaaactttaaaatgaaaggcatggaatttaaatatctgctccctttattcaaacaaccaaaaaacacaactttttaaatatattttatgtatgtatgaaatctaaatttatttttctctctttatccctgaatactttttaaaattattcatgtcctcattattttttaatccacttcagtcacattttaaaatatattttcgacttcattaagaatatctttgtgttccactgaatagattgccaaataataaaacattagcagtataatttcctcataaactttatttaatttgcttggttaaacatagatttcctactctcaactcataatttcattcaataagaagtataatatattctacttgacatttgcggggttttcataccatgcatttgtcattgaaattggtttttgatatttgaaccactagtttataattgtattgttagttagactggtctgtagaatctttcttcgttttgattctgtggtttattcattatggagtagctgtgctattgtaaattttgaggtcaaaagcttaaaacattttatgtattttcaaacaaagtggatggcatttaaatatctattccttaaaatttggaagaaaggttaacaccatataaacccagagcctgttttttagattagtagcacgtagacattttcaatttcttctaaagttgaaaaaaataaacattttatattcatagaatgcttgatgaaggtaaatatatttaattttcacttaaaataaatttggttacattgaaaggaaatttggctaatgtaagttagatacatttctaattaaaacaataatttaagataaataatgctcaaagaacagtggtcactgcatttattccagagagaggacatttatcctgatctgactgtaataacgtagtaggtagaactgctggcgtcgacacccaagcaaggaagggaagctggtgtctcaaggggtcccgctgagatggaaagggttcagggcccagactgttgatgtcgcctggacccaaccaccatgtctcagaagaagaaatgacactcccctcctggtgccaccccaaacaaggagcttagcagtgttgcacacaggacagtccttgcaggagacacgtttgacaagttgctgaggtgcctgatggggccaggctttttttcatgaaatgagtttgcatcgtgaggaagcctttttattggaaacctggcaggggtccaatttcccctttgccttaaccccgtaggagcacagtagacagggaggaggtcacccaggtggctgttcctgcttggcccccacttcccagaccattccaggcagggagagccgctgagatcactccatgggctgctcacatgtggtctggacgcagccgccctcctgtgcctggcaggcagcctctgggccatcagaggacccactgtgtggtgatcagtggcccaccacctgcccttgtggtgggtgcagttcacaggtgctgccccggtcctggcacactggccttcccagcctggcccaggataggggatgtgaatgatccttgcctgtgccccttcagaccatgtgaggttggacactcactgcagaagtccctccaggtcccttttcaactgagttgtgggggacttgcttagtcctcatgcccagggtcaggggaggggtgcagagtctgcaccctaaatcccctggggcctgagggaggtctcccaggtgacctctgtcctctccagtgacatgagtcctcccagatggcctcagccctctcaggtgacatgcttccatggtgactctggctcttgcaggaggtgggctactacagggacatgagctgcctaactgccatcctcctcctgtatctgccagaggaagacaacttctgggcactggatcagcggatggctgaggagaggcactccctgcagggtaggtggacagctacccccagggcctcacacagccgggccatgggacggccaccctggctgggcgatcctgacttccaggcaaggcagtttccttgctttccagcttgttaggagccttcaggacatccctgctgggggtcccagaggggcccatagctgaacagggaccctttcacttcaaggcggacacctttcattcccaacagcagagggcgctgcagcctccccctggccaccctgtgtgtcccagagccacagccctctagccctgagttcatgcaggtgactctcacttccccaagagtcctcctacctcccagctggccacactcccagctgcccccctagcccacagatgggccaatgaagtcaagatggcagtgtctgcccatcccatgtcccctagccagaccccatgtccaggagatggccatgtagtccttcagcacccacccggttccctccactagccactgcctgccccagccctgcctcacagcctcaaaggcaggcctgccctcctggcacctttacccaggatgctgctgtgcagtgcctccagctagggcccatctccctagagctgagaccacatggtagggtcacctgatggaagggaggaaggcctcagggtccggggtcccctgccactgcccagctcttccagctgatggctccacatcttgggagtgggctctgatgcatgatgggtcaggggcttctcaggtttctacagcccaaatactgcccagctccggaggctcctatcccaccaggagtaggtataacacaaatccttcccaaagatcatgcggtacctgctgagtggatgacaccctcaactctttcccagaggcccagggtcccatggggcagggaaacaagggaagatggagctcctcgagggcctgacaaggggctgagtcccagccagggcctcacccaagatgaggattctccatgggtttggagttgggtttccttttcctgccctggaggaggaggcagaggtactaggatgggggctgagctccagctgagcagggttaagggaagtgtgtccaccaggcatctgtgcatgggggagttgttgggaaagcactggccactgcccagtgttctgccccagggcagctcagggggccctgagcacctagggtccaggaagtgccgtgcattgaggtttgttgagttggctcctctggtgttttgctgatggggtaaggaggcaaatggagaccccaggccagggactctcctgtcccacaagtgcccagctcccccaggaggacctggctcaccccaagccagcaggaagcacaggaaagtttctgcatggcacagaagccaggccctcctcaagagggggcatcacactgcaggtgtcaggactcaggcccactgctatttccacattattaattttataaggtgatatggtttggctgcgttgccacccaaatctcatcttgaactgtaatttccataatcctcatgtgtcctgggagggacccagtgagaggtaactgaatcatggcggcagtttccccatgctgttctcatgatagtaagtgagttctcatgtgatctgatggttttataagcagctggcatttcccttgcttgaggtgatgaatgccccatttaccctgatgtgattattacacattgcatgcctgtgtcaaactatctcatgtaccccataaatatatacacctaccatgtactcatataaattaaaaataaaaataaattttttaaaaaagtgtgagttttaaaggtgaggtttgccctccagcgctggtgcctgccaggtgtgaccttcacatcatctttccacatggtccaggtccccatctgcagaggccaacagttcccagagtgaccttcctcagaaaacagggtcttggaggagacagtcagaggagggggcctcgtcctccccactgcacagccccttgtggggattggaagtgagggtctctgcccacaagttggcagtcaccctaagctgttttgtgggaggaagcatagggaatataggtcagtgctggaacagcatttcctgatcctgacttggagaaggtgttaaaatcttgacattcccgactcctcctttgtgagagcccctgtcctgcaggtctcacagggttgttgtgagggccacctgtggtgatgggtttggaagtgctttgtgaatgacacagtgggccttcctattcctgtcattggcctttcgaccttcaatactaattgcctggggatctccaggcctcaaggtctaatcctggaagggtatgagatgtccctagtggaatattctacacctcctgggaggtctctcacttcaaccttcacctgacataacccctgctcctgttccctcaacctggagagcttgcccaggagcacagggtagtactggactgacctctttggaaagggtgattacatcctcatttcagctctccctcctcctagttttccacgtagaaatccagggctccatgcagcatttgctggacatgaggggaaaacttttagggcaggcatctgccctgggtggggacagaggagtatcctggagtctgagtgtcaggagtgtgagacctgcccagctggccagcccctgtccccatgctgctcgatgcatgatgtttcctgcacaagcttcctttagagggaagcttccggagtgactgcagtgaggtccatgctgttgggggtgacagagcagccctggaggccctctgctcttaccctggcaggaggtggccaaaaagaagcaggcagaggaagcttctccaacacgcttggaaagaaatttccacatatcactcacgtcactcttgccactagaaggaaaatttctacagtggagtggaagaaaatgactatgctgtgggagagaatggatgcatccagaagagcaaggggggagggaaatgtgcccattgccagaattttgtgtcttttgaagacatttgccagaattctacttttgaaggctgccccttttgacagtcagttactgaggaagctgtgggacattttcaaagccttttatataaaaaaaaccacacaatatactgctgtgggtctgtgttcagggactatgaagagcacagctgccactgttctgtgtcgcagatgctgtgggaagtgccttaacacacagaggtttgcttcatgcaaccgggtgaggaacatctctaaaacattttacagtcaagaaaattcagtgttcaggaggttgaatgcgttatccaagatcacacatatgtcctgacagatttggggttcaatgaagaattatgtattttaattaagaattatgtattttaattaataattatatattttaatttcacattttaaatttctgcagttttcttccatcacttttcaccatgctttctacacttggaattactttttttggcttcttgatcttctttacttgtatgttattgattttctacaagttttaacatatatgattaaagagtatttcttaatgttttaataattatcctagaataaaatatatttactttgatgtatgcattggatattacagtgtattgtgtacattttcaaacactttgtgttataccagaagcattattcaacagtggtcatttttttacctgaactatgttcagaaaatctttccaccacagtacaaaaagatcgacttcattttgttaacagatggatgtgccatagtgcaattaactgtttaattatcctgttatcctgttgtggatatttaagttcaaacaatgcagtaataaatatgcaagagtgcttttagacattaaacaatatggctctaaattagggacctagtgcctgtaatcccagcactttgggaggtcgaggtgggtggatcacctgaggtcagaagttttgagaccagcctggccaacatggcaaaaccccgtttctacaaaaaatacaaaaattagctgggtatggtgatgcgcacttgtagccccagctactcgggaggctgaggtaggacaattgcctgaacccacgaggcagaggttgcagtgagctgagatcctgtcactgtactccagtctgcgggacagagtgagactctgtcccaataataaataaataaataaataatctagaagtacaattgcttagccaaatttcttatgcattttgaatgataagagttgctgcctcatttctgttacaaaggctatggtaatttacgctcaaaacacagaataggttggttgttgtcacatatggagtcttactgttgccgagactggagtgcagtggtgtaatcctagctcgttgtagcctccaacgcctaggctcaagcaatcctcttacctcagcctccctcccaattaactaggattacaggtgcatgccaccacacccggctaattttattcttagttatgggatcttgctatgttgcccaggctggtcttgaaatcctggcctcaaggtgacctcagcctccagtgtagctgacattacaggcgtgagacactgtacctggctgaatgagtgcctctatcctgacacttgtgtccccacgggatcctgcagaattcaggaccctgtccacacaggggaaaactctctgttggggtcctgatgactgaggagggagcttacccatggctctcctggtcatttttatttaatagtgagcacagaacctcacattttctggaatgttcccatatgattttgtgagagaaaagagaatagagaccccaaccccaagctcactgtgtcaaagggaaaattaagcttgggaactgagttacgcaatactgccttccttgttctcaaacacatagctataacttcacaaccctgtgtcatagcctcatccataagccaggttcacacagtgacagaaggccgcatgtctcctcagatgtcctccctcacaatttgctgtgaacccctaaatctttcagaatgcacatcccaccttaaactatccctaaaagtgggtcggctcaatttcaccctgacaatctcaattaccagcttattttcatagttctgggacaaggtcaggaccagaaatcatccctctgcctatcctgagatgaatgaatcattgagttttcctctactccactccctctattcacatgcttactttatcttatgtaaaatggagatttactgaatgtgagatgaacgcataactgtttcctctgctccctcctttcctatgtaaaatgtagatatcctgatgctaatcagagccacacaagaatgcaagcatttgcttcactgcctaccttcagtctcgcgggagttctctggatttcttgtatcagcatgtggacctctttagcaagattgaggacagtttcctcaattatatcctcaaaaacgttttccaagttgctcactttctcttcttctctgttagaaatgccagtaagtcagctgggcacagtggctcatgccagtaatcccagcactttgggaggccaaggtgggaggatcacccgaggccagaagtttgagatctaactggccagcatggcgaaaccccatctttactaaaaatacaaaaattagcgaggcatgctggcacacgcctgtaatctcagatacttgggaggctgaggcacgagaattgcttgaacccaggaggtggaggtttcagtgagccaagatcatgccactgcactacagactgggtaacagagtaagattctgtctcaaaaaaaaaaaattccaataagtcatagattttgttcctttacataatcctacatttctcaaaagtttggttcattatttttaaattctttttttatttttgtctgactgggttgattcaaaggtctggtctttgagctcttaaattatttcttctatttggtctagtctgttgctaaggctgtgaactgttttttgaaattcctatagtaaatttttcaatgcaagaagctctgcttggttctttctcaatatggctatgttgtcattcaaatccaggatcgttgttatggggttgttgctggatttcaactttctgttggcttttggtgattttttttgccacttatatcttgagtactatacctgtcatttcagacgttgcattctggttaggacgcattgctagattgctggtgtaatcctttggaggtgatggaacattctggctttttgtattgccagagttcttgtgatggtttcttctcatctgagagacttgatgcttcctttgttgaatttgctatcatttggaaggagtttttttttaaatttttcattctttctttctcttaagggtatgactgtggtgtatgttgtataggatcattttgcttcatttctgggtactttcagaggaccaaggctctgtacaagttccttggttgcagataggctcctgtggtggcttggtgtggtgatgtatttttgtttggtggtgtaattcaggcttcagtccagtagacagtgcttaagagtaacagctggctgcagggtcttctcctctgtgtacttgtcctcgacaggtgcagaagtgacaaagtgccaaaagcgccctgtcccagtgggtactagtcttcagcaggggcagagctgctggagaaacctaagaagcagcctctttcagcccacgttccttgggtcccaacaggatgaccactgctggatctgcagcagtgcactaggaaagggacagagggcaagagatgaccacctctctaaatctgttcctaggctttggtgtgcccctttcagcagctgatatcgtgatcgtgtttcctttgacccaaggggtggctttggcaagctgtattcctccttcccttagggctggtcctcaccaaagtttaggtctcctggggaatggggttcacctccctcttgtttcttggaactgatggagtactctctcaactgaccaagggagcaggctgagacacccagcaatgacacacacagaccagttccaggttgcaaagctgttcttggctgcaagtctcaccatccttgagaaacctctgctttagcaactctcttcccactacagtcctgcaagaggaaagagcctaattccaacacttactgctggagcactttccacactcaacactcaattctggctgttgaggctgctcccctgctccagagcaagcactccaattcctagcccaagattaaagtgtctgcagtggccaccattgccaggcaccaaaaaatgattgactttgtatgagcccagattaaaaagggcatccttctctcagtcccaggtctgggtaaatgcctgcagcttttctgagtgtctttcctctttccccatctctcagccacttttttgctagctccaaggcttgggagaaacagagtgttctcccttaatctggattgcacaaatccccagtgaaaaggtgagttgcagagggagactggctgctcttctctcgtactggagtttcactcccttctatgaaccaaatgctatcacagagtctgctttcccacctccccgtccacagggtctggagtgttcttctctattcctgtgaattcctatttttcttcttgaattgaagctcacaaagtttatctttatgcttatttttctacttccaagtggctgaggcacattgaaagcccctaatccatcgttctaggaaaaaaggatggtttaaataaaggaatgttcatataaaatatatattaattagtgcaaacatattttatttgacatgagttaggtgaatctttgatacattaattaattttaaaattgttaaataaaattagaaatatcttcgaatttgccaaggtatgtttctctcctgggattactggtcagttttattttttccttggatagacattttaagccataaatcttgacatagacctgatgtagacctccatacctttcccagatgtgggacggagcaactgggacaggtccatcctagcactaagggatgattaaacctaacttgtagtcattgtacaactataaacatggttgatgctttaagagaaagatcttgatggaaagggttaaatgtaaaaattgatcatatgaattgggtcattcttatcacaccaaataaaaccatcaacgagccagggggaggaggcattcagggcaaaaacaccactccaaaagcgtaattctctgcatgcctggctgctgaaattacctgctttaagctgaaaccagttttatcaaatggttactgaaacaacctcttgaacactaagactagctttacccaccactgtccctcacctatcagagcctgccagctctcaaaaaccttactggtgccagtgaactttctcaaagagaaatacatactgtttttctctctgtctcccttttttataaaacctctaactttctctttatgttttggacatactaaagacacccattctgcatgtatgtgtgaaattgtaatacttgtatctcaaataaaacattttaatttcagatgtttgtctctatatttatttgactttgacaatctgatattatttagcattatttccagtctcccaaataatgtcaaaattttgttatgttagataggaatatcttgttattcaacttgaaggtaaactgcttgatcaatgcatgtaattccttgacagtttgtcagcacctctaagacaacatgtagatattgctcattattaactcatttcatcttttcatgataaattacaaaaatttaattttcatttttaaaatgcaaaccattatgccttgtattatggcattcttgcattactataaaggaatacctaagcactacataatttatactgaaaaaaaagattgacttggctcacagttctgcaggctgtacaggaagctttgcattggcagttgcttggcttcaagaagggtcctcagggagcttttacacatggcagaaggtgaagcaaaagaaggtatgtcacatggccagagcaggagcaagcagggagaggtgccacacacttttaaacagccagatgtaatgagaactcactcactcttgcaaggacagtgccaagaggatggtgttaaacatgagaaatcagccctcatgaccccatcacctcccaccagaccccgactccaacactgggaattacaattcgacatgagacttaaagggtacaacatccaaactatttcattccatccctggcccttcaaatctcatgttcttctcacattgcaaaatacaatcatcccttctcaatagtcccccaaaagtctcaacctgtttcggcatcactcgaaagtgcagtttcttctgagacaaggcaagtcccttccactgatgcgcctgtaaaatcaaaacaagttatttatttctaagaaaattggggtacaggcattgggtaaacattcccattacaaaagagagaaattggccaaaagaaaggggctacaggccccacacaagttcaaatcccagcagggcagtcattaaaactcgatgttccaaaataatctgctttgaaaccatgtcccacatcctgggaacatagagcattcccatgatgcatagggtgggctcccaaggcctggggctgctctgctcccacggctcttctacactgaaggcatgagctgctggtggctctatcattctgggatctggagggcagcagcccccttcccacagctccactaggcagcccccccagtcaggaccccgagtggggcctccaaccccacatttccacttggcactgtgctagaagaggtcctctttgagagctccagtggtgcatagtcttctccctgggcatccagcctttctcatacatcctctgaaatttaggcagagaatgccaagcctccttcactcttgcactttgctcacctgcaggcttaacaccacatggaagccaccaaggcttatagtttgcaccctctgaagccatgacctgagctctatctgcagccctttgaaccaaggctggagctagaagggccaggatgcaaggaacaccctcctgggggtggtacaggacagtgatgccctggccctggtccaagtggaacaggaattaaaagaaattaaagaatgtgtaagcagaaactcagttgtatgtgagaaaacccagttccccctgagaaagagaaagagctggagccctttaaaaattaactgcctgtttttctgtggctagtgagcttcatctctcctcctttcccaggcattgtgaagaccctgtttccctagctgtgcagctgcaaggtcactagacagataaactcaagtcgtaaaacatgtttttccttgaaaagtaagaaatgatataatgcatgtctcaattaattgaataactgtctttgtttctcacttctgtaatatgcttccccctgcacagatctccccactctccaccaccccacaaaatgcttaaaagttaacttaagtctttgttcaggactcagtcctttggttgttaatctgactgggccggtgcacctaaataataaatatcctcctcaaccccatcagtctctctgattccttaaaaaatcccgctacagcctgggcacggtggctcacgcctgtaatcccagcactttgggaggctgaggagggcagatcacgaggtcaggagattgagactatcatggctaagacagtgaaaacccgtctctactaaaaatacaaaaaattagccaggcatggtggcagtcacctgtagtcccaactacttgggaggctgagacaggagaatggcatgtcccggaatgtagagcttgcagtgagctgagattgtgccactgcactccagcctgggagacagagtgaggctccgtctcaaaataaataaataaataaattaattaattaattaatttttaaaatcccactacacaagaaaccattctttcatcctagacctctaggtctgtgctgggatgagctgctgcaaagatttctgaaatgccttcaaggcctttttttaattgtcttggctatcagcacctagctctttttcagttatgcaaatgtctctaataagtggttgctccacagcctgtttagattcttcccctgaaaatgctttatcttcctttgccaaatgggcaggctgcaaattttctatacttgtatggtctgcttcccatttaattgtaaattccaactttaagtcatttttttgctcctgcatctgagtgttcaaacttcctcagatccctagtacatgaacagactgcagccaagttctttgcaaaggcataacaggcatgacctttattccaagtcccagtaagttcctcattttcatctgagaccgcatcagcctatccttcaccgtccatatcactatcagcattttggtcacaaccatttaactagtctctaagaaattcagaactttccttcatcttcctgtattaggagccctccaaactcttccaactcctgcccattacctagttccaaaatcacttccacattttcaagtatctttatagcaatgccccatgtctcagtaccaattttctgtattaggccattcttacattgctataaagaaatacctgagactgggtaatttataaagaaaagaggtttgaaaagaggtttgtatagctgcaggctgtacaaacatgattctggcatctgcctagctcctggtgaggcctcagcaggctttattcacggcagaagatgaagaaggagcaggcaggcacatcacctggcaaggcaggggaagcaccacacacttttaaacaaatagatcttgcaagaattcactcactatcacaaagacagcaccagggacaggatgctagaccatttctgagaaatccacccccatgatccaatcacctccctccagacctaccaccaacattggggatatcacaattcaacatgagatttagagggaacaacatctgaggtatctcatgcctcatgttgtgacttggtataatgtccataagattacactgactttacacatcatattgcagtttttgctagctcttctgtagtaagaaaatggaattcatcagcaatgccttctaagtctggctctgttttcccatgcagactattccctgagctctgcttgtcagtcttgctagaacctcaccctaggcagcaacctccagtctgagattgcccttgacagtggctgaggtttgcattgttggaatggattagaaaaaacaaagggaagacagaccaaaacagatttaaatacagatcccatttgttgaagttttaagtaattgtaaatgtttatttgcaccagctgcccactcccattgtactctcctcacccaaaaaggtgacttgatattctagtaaaaagccaaactgtgctttagagaaacccacttgttacttctttaaatccatattatttttccaaagtgaatttttcttaatatgctctggcagaatcagtaaactaattatttacaccagagtcacttaacctttcctcttggtcatttgcatgtaaattatttttatatgtataaaatttgcttactcaagaaagctcttgctatatatatatatatatatatttttttttttgtggtatcttaacatactctagtcttgtcttgaattccttaagactttgaggtaaagaactctattgtaacaagtttccaaatcaaagtgggaaagaggaagattaggttaagcattaggtcatcaggtatgtaggacagctaattccattatcagaatggtagtgatagccagtttgcattttgtatattagttgtaacgaaaatattcagcatattagtgacaaaaccaaagttattgtgaatcagtttataatttattttttgagataggatcttactctgtcacccaagctcaagtgcagaggcatgatcttggctcactgaagcctcaaccacctgggctcaagagatcctcccagcccagcctccttagtataggtgagtgccaccacacccagctattttttctctagtttttgtagagattgggtctcactttgttgccaaggctgttctcaaactcctgggctcaagcaatccttctgcctcaacctcccaagtggtgctgggattacaggtttgagccaccgcacctggccagtttataatgttaatggcttttggagcaggaaccagtgggtgctgcttcttgtctgcaagatgaggagtctcctctccccagaagtgaggcatcttctaccacaagggaggctttgcccaaacagtcaccgaaaggcagagattggggagagaacaaaacaggagtgaatatgttcctggaacctaactgctccccaattcaattctactgcagacattcagaatgaaggggacattcagctgaagaacaggagtgcactggctgttaaaatctcagattgtaaaaacaattttgcttcattttccttaaataatttttaaacaattgttcttaggtgattttctaaacttcaggtaatatctgtgacttagtaaatgttctttaaaagatgggataatatttttattttgtttaattatatgtgtttttaaactaattttataggaaaaataatttctttccttccctgttataccaaatacagcctttagctcaagacacaagtaattccaggaaaactggaatgtaagttcaatatgttgcactaagtacatttgaaagtgcatgcatttttattttaattcatcattctcagtcaactatcgctggaaaccatcattcttagcaaactatcacaaggacaaaaaaccaaacaccgcatgttctcacttataggtgggaattgaacaatgagaacacatgaacacaggaaggggaacatcacactctgggggctgttgtggggtggggagagcggggagggatagcatttagcctaaggctaaatgtcgagttaatgggtgcagcacaccagcatggcacatgtatacatatgtaatgtatacatatgttaatgcaccaattctgcatcaagtcagtgcaatcagagacactgcaagaatgacttttggttttcttttcctagtttttgaaagtttctcaagtctgtcatactggactctgtattacatcttgaatttttttcacttactatagatctcctatacgctcaattgtttagctattaccttaacatttaccctgtgaacccatgacatttgaggctgccaaagtgattattacatgataaaacatatactcggttaaaggcaatatttaacaattgtaaaaccaataaatcaataattaaatctttctggcttagacttaaaactgcttaatttagtcatatctctacccacaatatagggattccagcaagggttgaaagtagagttggcaagcatttccattctcttctgggacaataattcttactaccaacactggttctgaccagtgaaattcaaaatcagtgaaacactactcagagtctgagtgagccaaaaatagtttcactttaggaaaaagtctatatccttagatgtgagtgattctctgtgaacattttattcactttaatatatttaaagaaaatctttctgaattggtgtgttttctttagtttgtattctgatactttgatgctaaaagcttttgactttaagttttcatggaggggctatctacataataatttttatacatcattatatgcatcaatgattaaaaaggagtagaaatttttacactaattgagaaatattatagacctaactaaatgcgggcaaactataagcaatttggggaaactataaggatgtaattaaatagtcactgtttttagaaaccattaactgcatattgaaatcttgacacttgttgggaaaatgaggtggtaaatcaacttgtcagcgtgagtactaaataaaacaaaatatggttaagagtgtccctttaaagttcagatagtagttctgcaatttctgattttaaatgtttctgcaaaatagtttatctgaatgattaaactattattccgtgttcaccaaccattaagaaaatctgctgtatgaccaggttaaacctgaaaatggtataattcaaaacttgatgtaggcaataggtatgtagaatgtgtttattctaatatgagagggcatatcaaagtaattttcttggagcacactgtcaaaacaaagcaatgggatttggccatggacatttcattattatcaaagagacctggacactaccttagagtaataactttattatttagcaaagatgttttataaaaagaacaacaaaatgagaggaatagaaatcacacaggtaaaacagataatctgactttgtgggtctcagagcagagattagtgtctttcagtttcagagtaaatgacctcactgcatttctctgaactgtcatggttgtcacaaatatactgtgttctaactcactccatgatttaaggtctacaaagtaacaaaggcaaaataacctatatgctctaccatattttcctcaattctagtgttcttcaaagagagaatgttttctctaaatctaattgagagtaattctgtatggatcgctaaacctttcttcaggcagttggagtaatatgtgtctagggctaactcagaggggtcttttatgtcttttaaaagaagctaactatactcttgtgatatgataatcaccgtcattgacttacagtttctaaggtttgaagggatattgaacactcaaggggctcacattcttactgattcatgaatctcttcaggtccagggaacttagtatttttcaagagtgcaaaatgcctagagacagctgggaacaaatgaatgtcattcctgatactgtgctcatagttacttgagcttcatctcagaaaacaaattgtctggtgcaatatttcttacaacttagttcctaaatgaactcaacaaactagttcttttgttttattttatttattactattatactttaagttttagggtacatgtgcacaacgtgcaggtttgttacatatgtatacatgtgccatgttggtgtgctgcacccattaactcgtcatttaccattaggtatatctcctaatgttatccctccccactccccccaccccacaaccgtccctggtgtgtgatgttccccttcctgtgtccatgtgttattgttcaattcccacctataagtgagaacatgcagtgtttggttttttgtccttgtgatagtttgctaagaatgatggtttccagcttcatccatgtccctacaaaggacatgaactcatcattttttatggctgcatagtattccatggtgtatatgtgccacattttcttaatccactctatcattgttggacatttgggttggttccaagtctttgctattgtgaatagtgccacaataaacatacgtgtgtatgtgtctttatagcagcatgatttataatcctttgggtatatacccagtaatgggatggctgggtcaaatggtatttctagttctagatccctgaggaattgccacactgacttccacaatggttgagctagtttacagtcccaccaacagtgtaaaagtgttcctatttctccacatcctctccagcacctgttgtttcctgactttttaacgatcatcattctaactggtgtgagatggtatctcattgtggttttgatttgcatttctctgatggccagtggtgatgagcattttttcatgggttttttggctgcataaatgtcttcttttgagaagtgtctgttcatatccttcacccactttttgatggggttgtttgtttttttcttgtcactttgtttgagttctttgtagattctggatattagccctttgtcagatgagtaggttgtgaaaattttctcccattctataggttgcctgttcattctgatggtagtttcttttgctgttcagaagctctttagtttaattagatcccatttctcaattttgtcttttgttgccattgcttttggtgttttagacatgaagtccttgcccatgcctatgtcctgaatggtattgcctaggttttcttctagggtttttatggttttaggtctaacatgtaagtctttaatccatcttgaattaatttttgtataaggtgtaaggaagggatccagtttcagctttctacatatggctagccagttttcccagcaccatttattaaatagggaatcctttccccattgcttgtttttgtcagctttgtcaaagatcagatggttgtagatatgtggcattttttctgagggctctcttctgttccattgatctatatgtctgttttggtaccagtaccatgctgttttggttactgtagccttgtagtatagtttgaagtcaggtagcgtgatgcctccggctttgttcttttggcttaggatcgacttggtgatgcgggctcttttttggttccatatgaactttaaagtggttttttccatttctgtgaggaaagtcattggtatcttgatggggatggcattgaatctataaattaccttgggcagtatggccattttcacgatattgattcttcctacccatgagcatggaatgttcttccatttgtttgtatactcttttatttcattgagcaatggtttgtagttctccttgaagaggtccttcacctcccttgtatgttggattcctatgtattttattctctttgaagcaattttgaatgggagttccctcatgatttggctctctgtttgtctgttattggtgtataagaatgcttgtgatttttgtacgttgattttgtatcctgagactttgctgaagttgcttatcagcttaaggagattttgggctgagacaatggggttttctagatgtacaattatgtcacctgcaaacagggacaatttgacttcctcttttcctgattgaataccctttattcccttctcctgcctgattgccctggccagaacttccaacactatgttgaatatgagtggtgagagagggcatcccagtcttgtgccagttttcacagggaatgcttccagtttttgtccattcagtatgatatttgctgtgggtttgtcatagatacctcttattattatgagatatgtcccatcaatacctaatttattgagagtttttagcatgaagtgttgttgaattttgtcaaaggccttttctgcatctattgagataatcatgtggtttttgtctttggatctgtttatgtgctggattatgtttattgattttatgcaagaataatctaaatttctctggtgaaagaacctaaacatgccttttaaaaatttatatatcattccttttgtaaaatctaatgaaaataacaattttgtctattgtaaaaggcaagtgattgcaacagatggaaatcactttatttcctatatctttgtaaagataatgactgctaataaacaacatgaagaattttcaggtataattttgataaaaatttaatggttttgggcttctaggccaaatctgcaatacaacccttcataagattgtactttgaaactctcgttgtcatctgacatatgcagatagtacagaaatataatcccctttctaaatgtttacattgtctccctggtatgaattagcttgctggaaacatcagtaatcactgacataaagatcccactattaaataaaactgatactttttaaaaccatgcagcaaataagaaacatttcataaagcaacacaggattttatatgtttcccattccattagaggctattatgctgaattggatcctcattccaacctgtgtccatattttagggttgaaatagtctaaaacataacatttactgttctcctgttgtgatatctgtatagctaatatgttcacattctctgtattcatctatgttaataattttaaaaaggaaaagaaagggggctttaggaagaactttacatcacacgtcagagtaaacatcaaatcaagttctcaattcactaataaacccatttaagaaaaagtattccgctagagagcaatgaatcttattgtctttgtgtctgatccatatttctccacctgacacatggaaataaccagagagttactataaaatacctcaggtgcattgttgaaagtaatttcctgcttttgtgggataactgaaacataaacgtaaataagatagtttgaaagttcactttctcatcaatgctcaaataatttgttctaataaagcccagtaaaatttagcttgtaatgccatcaaggtaaatatattcatgaagtactcacttgctaaatttttaaacacaacacattatctcatctttaagctttagctgttatttcaattatccattgctgtgtaattagcagtcatcaaacttagttgcttaaaacacaaactcacaatttgttaactttggttgggctcaggaggataatagtcggagtcttgcctaggtttccttatatgactgacaaggcctacatagtccaaagtgacatcactcaaatatctggcacttcactggtgctatcagctgggttctcctccacttagtctctctggtagagtagatcaggttctcatttggcattgctgccattttaatttggcaagcctaaatttactataatttgtcaagtgtctattaagtcagtgtcagagagggctatataaggatatggctatgaggagacttaataaatcgagggttctttgatataacaggctacccagttacatttcttgttctaaagattttttcagatacaacaaacaatattttacaatttaactggtagatgaatgagtttcctgagatataatttaactaagcaaactctttcatactaaaaatcttatgacctctttacccatcttaggttttaagattgatatgagaggtattctggaatagaaatctaaatttaaggctagagtcaagagtgccgaagataagactcttatccaaaggaaaatcaagcaactgctatgtcttgcaaaggccagtgagcagacagaggggagagaatacaattgcaccaaataaagactcactttggaactcagtgattatatgtgtgcatatatgtgtatatatatgtatattatacatgtgtatgcatgtatatatgtatattatacatgtgtatgcatgtatatatgtatattatacatgtgtatgcatgtatatatgtatattatacacatatatgcatgtatatatatgaatatatataaaactgaaaactgcacacatcccatatacaccatatacatgaaagtgaacacacacacatacataaacatatatattcagtttcaaacaattgttagggaacctgaggaagaaactaaatggaatataatggttgcatctatgatagccatggtactagaactagtagtagttctactaaggtgagaattgacatagtaaaagaaataagatacaaagcagtaagagagagctacattttccttaaggccaggctgaatattcactaacaaggaaatttctacagtcattattttaatctgattcattctcttggtgggatattccagagttaccacctacagaaattccacttttccttaccgaggttctctttttttcttctcagtccaaatattagtcattttggtagagaaggcagaaacaattaacaattgagtaattcctcaggaatcatgttaaaaggtttccaaatcatgaatgtatagttatattttgttcactagattttaacccacatacctcacttgtagagaaattatgcttatttggatattcaatatatttcttcatacaaagacaaaatctataaaatgtacacacacacagatgctatggatacatgcacacatgtgcacacacaaatatgtatacatggtttaccattattttctagatcattcagaggtcagtattaattaaaacatcatagatctatggcaaattttgggccacttttcctaagacaggaatttaaaaagccttcaattgtcataacaatgggaagaagtctgagagctggagtaagggaagttggtgctcagaaatattaactaccatttatataggatatccttatgagataatcttaaagccaaatgaggctaaaatattaatacgagttatttagccaagttttccagcaggaagaaggaaataagcagtgaactaaaaagcatacaagatacagaggagcaggttaaatgaagccattacagcagaaattgagaagaataaacaggagttagaagatgagagcaagcaattgcaagtggagtgggctgagctggaattatggtgtagaaaatgactggttgagaaaaacccaaacaaatatttctataatgtcatgtgcataagatacctgtagatgttatcaaggtatatacataaactacctgtcattagagctaatttcttagcaaattattcataaaagtttataactttgtgaggcattacagacaccaaaactaatgatttggcatttccgtggcccaatttgtctaaagaactatcttttacactttactgttttttaataggcaatacagtgctcaaaaagtcttttataccaagtccagtaggttgataacattgagtataactgagtattgctttgtgtctaccctcaggcaaatctggagattttctcaagcctctttatgaaaatggagagacctcacaagagatgctaatggacagctgaccctgctccctgctccatcacaggttgtagagtattaattcccaagttacccagacatttagttctgaatgtgcaaaaatggtttaggttcaaatgttttcaactactgacaagctcaagaattcagaggaggtagtactaagggaaatgtaattaatatataatatcaaaacttaagcatagcaccataacacctaatttttgatgatgtcaaatacttaaagttctccctttttattttctggtgaaaggtgcgtagtatacaaacctctactaacttcttgggcttctgaataaaggaaaggactacctaatgactgtaatagcttgactgctgaagaattatgtcaattaataaaaattgcttcataggaaaaagatgaattgtctcttcaaagtttttttaagcatgggtgaccaaagccatcccatacttagaagaaaatattgcattgttttatacaagatatgctgtacacgttacagaagattcatgtttaataatgcatcttgtaaaaatcttagagagctataaccttacaacataacttaacccaaatacattgaaaaccccttggatttagacctacagggaggtggtttttctttctgtaccatagcacgcatagttgaagcaaacatactccttcaaacataatactcttacataatagaaagtgttctctgttttctggatgaaaaggcatgaggtcttttgtattagcaaactgaaattgttaactataaaaagtcaaaaatcaaaggtgctctcacttatttataaggaccttgaatggctgagattcatcaggaaaaaaaaacattcctcagagagtctgatctcaagctgatgtttctttattgaatttgattctaaaccatcatttttgttgaaacctctgtgctttcagaatgctgaaatgtaaaatatttttaacttatgaaagagataatttatttttattttctcctatacatttttaagtagcaccttaaaaaatagacaaatccatccagggtcaaaagaactcaactcaattctctatcactgtgaaaatagacttagttcttcattacaaaagcactacaataactacaaaaattatacctcctggagtatatatttacatatccatgcaaaaggggaatagattaaaagatgtttatgaatgtctaaaaccttaagtcagtttaacgtagtattataaatcaggtttgtgggtgatattttgtctgcttctagacttgtgagcaagttattaagttttaggttacttatatttaaaattcaaaaaggaaatgattgtgattgcattcaaagaaagagaggacattttgaagcttcttttttttactaatatcaaaacataatatcacatttgtaaaacacgttgatggcttacaaccaagtaaaatacctcaataccccacttttcaagatcagtaatattggcctaagagtatcactctataggaattataaaaagttgtatttatgccctgagattataccctataatgtgcaaatattataggatagacaagtggatataaggtttctttctaggtttccttatatactccaaatggtaaaactagatggaagattaaaattctaaatgttgttaattttagaaccttcaatgtcagagttactttgtatgaatgagtttagctaattttccacactatgcatatctaatagaaattactattgcacaggtgagaaaactgcatctctgattattattattcactctagtcacagagataagaaagggcaaaatatcataatagaagcccaaataggtcttattttaatggaatatttttccactggacttcaactggtttatcttatttatccatccatctaagatcagttgaaaaaagagacttgcagatgcaatattttagctaatatatccaatctcctatttgaaatctcctgcgtatctaacagaaaactcaaatttagtatgtctgaaatcaagctgactgctgcacgtgttcacactgaaacaaagcaaaacaaaattccttcaacagcttttctcatctcaataaatggtactacactgtgcctgtatgactcatgcccaaaacctagaggtcgacctaggttctttttttccccatgactctccatttccaagatttccgtttcttccgtgaacacttctcaaagccacacccatctctctgtcagaataccacaatgcattgcaaatctgcctccccacttgtcatctcctccctaaatgctctattttcacagtagtcagagtggcttttttttttaaagcacacaagatcttgactcttcattccctactttctgctttaactccttgtttggctttcctctgctaatataaagaaaaatttccaacttctttttaatgaccatagatcctggcttgatgttttctacctacctctccaaccacgtcatacacttcccttcttttcttatcacacccaaaacattcttaattatttccacagtctttgtatatgccaaccctttttctgcctctagaattttgtgcttgtttctctttctttctaaaataagctttcttggctttttgtaaaattagatcattgttctttgaaatctcggctaagaagttttctgaaataccttaattaaagttccttccctggttactagcagtctcctcacttcgtttatttttattgtaatctttaatgattgctttctatttgtttgacttcttgatcaactcaaatttgtatcctcagctcttatcaaaatactaggtaactacacacttattaaaacaactaaacataaaaatagtgacaacaaaagctggcaatgatgaagaaactgtatcattcatacattatttgaattgtaaaatgttataatactctggaaataatttatcagtttctttaaaaactaaacatatatttataataagatccagcaattgcacccctggaaatttatctaagagaaatgtaaacctatatgcgatctttaatatctttcatagcacctttaattctaacagagaaaaactggaaacatccaagatgttggacaggtgaatggttgaataaactgtggtatatccatatgattaaatactacccagaaataaaaaagaatatacttttgacacatgcaataacttgcatagatctgaagggcattatgcttagtgaaaaaaagcaaatatcaaaaggacacatggcatattatttcatgtatataactttaataaaataacatacatatagaaaacagattagtgatttccagaggttagtgatggtatgggaatgtgagatgaatatggctataaaatgtgaggaagacacttttagtgatggaagagttctgtaacttaattgtaataatggtcacattaatcaatacgtgataaaattggcatagacctatgaattcacattgtataaatgtcaatgcctggtcctgatattgtactaaattatacaagatgtaactcttgaaataaactgtgtagaatagtacacgagacctctctgtatttgaaactccctatggatctaagatcttttcaaaataaaaagctaaaaaatgctaagtgttcaataaataaaatagtaactgtattttatccaattcttaccatataaaaatgcttcacatacattaactcatacaattcagtctatagcaagatcatattgatgccattattagtcctaatttatggcctagtagcttgttcaaggtcacatagctaataggaggaagggttatgattttaatccaagcaaccagctccagagaatgtgctaccaactgacacatcacagcgtttctcaaaaataattctggatggaaggaaagaagggagttaaggaaggagagagagaaggaaggaaggaaggaaggaagggagggagggagggagggaggaaggaaagaaagaaggaaagaaggaaggctggaagggagggagggagggaggaaacagggaaagaaggagggaaggaaggaagatacaataaaggaaggaaggaaggaaggaagaaagatacaatagccagtatatttactcaaagagaagacatcataaaacccttttaacaaacacagcctgacgtctcaaattccttctccattcaacttccttgactgtagagtcctattcagggtcaagggaaggagaaatcaaactaaagatcataacgctgcatgtatgtggcattgtattgccagagttctctgagtaaacctttctagagatgcacattttgcactctattggaaaagttatcttagttataatgtttctgaagatgcatttgccatattgaaagcaagcagtcacatacaatttgatagacaccagcacaaatgacaataaaaacttggtaaagttgaagagactgcctttgttatatctaatattctatcaccccagatctatcttctcaaatctccacattacttagcctaaccctatttttctattttctagaggagcccaccacattgatcaggttgatttattcacattttcccaaaaatgctaggtagattccttcctaaatccattagtaagttatagtctgtattccccatggatgaactgtgttcaccagttatgactcttaggaggaacttcatagaagatcttcagtggcatctattggtacatgttggacattaactaaaaatgtatagttttagcaaccaacagattctattcttatacctgttggtcatgtccaggcagttatgtgtaaaataattacacaatgtttcaaaatttcaagatgtttgcctacctatatagtgtccttcactctcctctccagctttccaaataatatccataattcaaagaccagttaaatcctacaggcatattcacagaataactgccctgaaaacattgcttaaattaatgagaccatctatgggcaatgcatcttcaagagctcaagatctggtgaaaaaatggaaacaaagatgaaatttcaatacaatgtgatgaaaattttaaattatttctctcttgcaaatttccattgcttgtttgaacattcaggagaatagtactgctttcccattgaatgtataaataaatgtaagaatgaaggttggccctccctccaaattcattaaacattaaattttttaagtaaaagataagagggctgtatgaaaattaaaattcataattacttccaatatagaaaataattgaaatagataaaaacacaaccaaatagaaatggatattgctaaaaatcaccttcttaattaaattagtaacaaaagtgaaattattgttctatccatattggtgacattgcttcttaaattattcaaattaaaatatattctactggtgagttcaggaaaaattgacaataaacaaatagtatcatacacaaagaaatataactcactgttttagcctagcaactagtgtttacagaacaagttacagattattctgcaataagaaacaatcctaaagtgtttttaaccttaaatcaaaattcaaattagaattagaaatgaaatgatgttctcatttcagcaatgaatacagaagtgaaatcacttgatttttctgaagactgtatttttcagtgttcatctggatttaacactttaaagaataccttttattccttaaataacattcagtttgtgaaagtaagcacacctttttcagctccgcttattctgcagaaggatccttccatatcaaggattaacacaatatgcatcgtgggttcacaaagttcagtttgcagctatccttagcaaatcatgagaaccatctggactgattgatgtggagattgaaagtaattgatcctgccattgagaaactttttgaaacatgaaattaaacaagatgatattaagcattctgaagtccatcagagtggcacatcaaatgtgttactagctgttcattttcctttgtatttttataaagacccttggctagcagaatggaacagaaatagaagctaaaagatctagatattgatgtagtgatcaaaggcatacagctggtttactttgttataataatattttatgtggtacatgaagactttgatcccttgacaaatgtcctttgtaggtgagcaattattaataggattgtaagtcttaatatgcaaggatcaccattaataaaagtagactattgtaaagtgaattagcaataattttacttatgaataaaaacttatactatttcaggtcattttcttattgtttcttgaaaaaagaagtcctttataagtccagttaaatattacctaatttttgcataaaatttcatggtaaacaaggcttattttcttactttactgatgtctaaaagctaaatttcactggtgatatatcatttgtttaagactaggtaactgataacctaagctgagacccaaaatttgttattttctttatttccagcacaatattttccatcatggtaaaagaagctatgtttctttagcaagacaattgaaaagcataaacaatggtttactagaaagatttttaatattccatattatttacaactgtttgcttatttccatgtataaaatgacattgattcaatagactttttccacatttgcatgatattcagctataacattaactcaggcaatattcatatggctccagaattaaaccggtatctgacctcccaattgaattagacgataggcattttgtgatttgaggaagacatcctatgaatttacaaatgtccagaaagttatacaaaagaaaaacaaaagactttagtctagttaaaagtagtgctactatttcttgaaattctgaaagctgtaataagtatcactcccaaatctggggataaagtacagaaaatggcagctcccaatataatcttggacatatttgtcattaagaagcacaatgaaatatgacaaattgtacagcaacttttaaaaattgctaataactctttgtttatctcagtagtaaaatttaaatactgatccaacctgacacatatgaacataacatacctattctgaaagacaaagaatatgtatcaatatttatattatatttaatacaaatcatggaatatagaattatagaattgtgcctacttacctagaaaatattaccccaattttgtttttctaagcttcaagagagatttcttggagaaaatgagattttataagcaatgctagcaaaaaaagacaacttaaaagattatggagaaaaaggcgtattttagatacaaaacacagattgagaaacacttaggggcaagaagtaatgcatcactggccaatgtaaatgaaccgtttaggcagtaaaatgtgtccaagcaagtggtgagtatatcctgttctcttttatatatctagacaagtgatttcaaacacccacgtggagccctgagaccctgggtgttcacctaatgtaagccccaatataggagctgaggtcaactaattgagggaatatgtccaacaatcaataagcaaattagaatgagctaactgtcacacattcttaccctcatccctttgctgcattaactgagcaaacagctctctctaactatgtaggaaaagtgttagtactcaaataaaaaggtaaatttaataatctgcttaaggctgtatgaaaaaatgaagcaatgtgtatcaggtttcttcaaatatatgcatattgcaatccacccttatttaccctcgattgtaagagctaaaagcaggccgggcacggtggctcatgcctataatcccagcactttgggaggctgaggtgggcggatcacgaggtcaggagatcaagaccatcctggctaacatggtgaaccccgtctctattaaaaatacaaaaaaattagttgggtgtggcggcgggcgcctgtagtcccagctactcaggaggctgaggcaggagagtggcgtgaacccgggaggcagaggttgcagtgagccgagatcacaccactgtactccagcctgggcgacagaacgagactctgtctcaagaaaaaaaaaaaaaaaaaaaaaaggaaacattttgcaaatgttgaatttaaatgcatatttctgctttcatatagcttatatgataataaagctatatgcaccagcagatatattaagttttatattatataacatattatatatattttacactagataatggaaaaatggtacctattatgttggtgaccacaattttggcagccttagaaaaacttcagggccgggcacggtggctcacacctgtaatcccagtactttgggaggccgaggcgagcgggtcacgaggtcaggagatcgagaccatcctggcaaacacggtgaaaccccctctctactaaaaatacagaaaattagccaggtgtagtggcgggcgcctgtagtcccagctactcgggaggccgaggcaggagaatggcgtgaatctgggaggcagagcttgcagtgagccgagattgcgccactgcaatccagcctgggcgacagagcgagactctgtctcaaaaaaacaaaaaacaaaaaacaaaacaaaaaaaaacttcagagcataagccaaaacaattagaaatagcatggctttaaattaatttttcaagaatcttaaggtgacaaatattctgtcatctgtcatgcaaatctagttccacagaagggcaaattaggaatccattacctggaaaaaccattcctcatgcctagaagaagaatctctacaagtaggattcttgctttcaacatgcccttataaattggagtcagactgaatcattttttcttggcaatggacaagaaaatcagactgtaactgtagctttgtcactgagaattggtcaaccatttcaaaataggttaagttttctccctctgatgtttctactggggcttgaaggattgataaatatgcttctattctctgtcagaattttgaactaagggagagataccaaagattcaggcagatggagatcaagatggcaggtttatttttaaaggagctatggggaatctttgtggtgacaatagatttttctgttactgtagacacacataccttcccagccacaagtggtgctagacaactgcacacctctccatcccacctcccatcccaacagatacataggcattttcttcagatgttgatgaaaataattattttatcactatatccagataattccaacaagcaatatgcttgttgaggtgaaataatttttctaagatacaaacagaaaatatatacgattgaaatagacactaggtgatatttcacatatgcaatatgagctctgtttctttgacaagacagatgaatgaagaattcatgtttgaatgattggcattagtctaaagtattaaataatgaaagtgtccatattctctgcccagtatgatcttttaaaatatcatccacacaaatacaagtgaggtcatattttttacaatgaggcatcaaatttaaaggcagcaaaaaagtaatgaatatacctcttaggctaattgtttaccttagtggctttaatgatatggaaagttgaagtttagagtgagaaaagcaccaaaaaagaaactaatcagtctcctgactttcatatctggtagtcttagaatgaatgtcagaactgtcacaggtcaaataatggcccagtatgttttcaaataagtgacactgaacaccatgttttagaagtacatgattgtccttcttgatgttaatctcacaacttaaggacatgcttgccaaacatcataatttcttttaataactcatgtcagataaatctccagtggagacctatgctctggactccagacttatgccaagtagcctaattactatctccacttgcaggcaaaataggcatctcaaagcgaacatacctcaaaaagagctcttaatctcctactattctccccacttacccagcatcttccccattctcaccttctctcatcatgttcctcatatcaggaggtaatagactccatccttatagttatacagttattaagccacgaaacaccctgtttatacccttggcagccctatttttttctttaattatactttaagttttgtgatacaggtgcagaacatgcaggtttgttacataggtatacatgtgccatggtggtttgctgcacctatcaacctgtcatctacattaggtatttctgctaatgctatccctcccttaccccccaccccctgacaggcccttgtgtgtaatattcccctccctgtatccatgtgttcttattgttcaactcccacttatgagtgagaatatgcagtgtttggttttctgttcctgtgttagtttgctgagactgtggtttccagcttcacctatgtccctgcaaaggacatgaacacattcttttttatggctgcataatattccatggtatatatgtgccacattttctttatccaggctgctatcattgatgggcatttgggttggttccaagtctttgctattgtgaatagtgctgcagtaaacatacatgtgcttgtgccaaccccatcaaaaagtgggcaaaggatgtgaacagacacttctcaaaagaagaaatttatgcggccaacaaacatgaaaaaaagctcatcatcactgtgccgggtccatcccgcagaccctggctgagcaacagaagaaaggagtactcagacacaaatatacagggtaagagcaggctaggaggctgcgagccctaggggcagaggagagttagcagtctcgataagccagagctgcttgtatttattcagtactggtataacgtccaaggcctggagtcaacacaattgctgggtaattaacatttttgctccctcttacagggagcagtctcatgctcagaagttcaaaagtcagtttcctgatgacataagtaaacaagcatatttagataaacttcttcacttttccttgcacctacttctcacccttagcctcagagaaagagaattttcttccttcacctttattctctcatgaagcttttgcaagaccttccaacctttcaagaaggcttgcgtctttccttatagcttctcccaccaccctgaccgatctcccacatcactggtcattagagaaatgcaaatcaaaaccacagtgagataccatcccaagccagttagaatggcgaccactaaaaagtcaggaaacaatagacactggagaggatatggagaaataggaatgcttttacactgttgatgggagtgtaagttagttcaactgttgtgaaaggcaatgtggtgatttctcaagattctagaaccagaaataccatttgacccagcaatcccattactaggtttctacccaaagtattataaatcattctacgttttttttgacatggagtttcactcttgtcatccaggttggagtgcaatggcatgatcttggctcactgcaaccaccacctcctgggttcaagtgattcccttgcctcagcttcctgaggagctgggattacaggcacccgccaacatgcccggctaatgtttgtatttttagtagagacagggtttcaccatgttggccaggctggtctcaaactcctgacctcaggtagtccacccatctcagcctccctaagtgctgtgattacaggagtaagccaccattcccagccaccctcatttttttatagctcatactatgttaacaaattttatcaatagtaattcaaaacatcttcagattctgttcctgtctcaccaccatcactacccccctgattcaaaccaccatctctccactctccagttaggtttactgctatagccgcctaactggtcttcctacttccctgtagccccttgccttcagtctattcttgtttctgcaattagggtgattctttaagaataagtcagaccgagccattcttctcttaaaaccctccaatgacttcactctccatcccactcaaggtattagtttcctcaggctactgcaacaaattaccaccaactgagtaggttaaaagtacagaaatttattctctcacagttctggaggctaggagttgaaagtaaggtgtcatcagtctcagggtctctgaaggctccaggggaggatccttccttgtcttttcctagcttctcacagttgccatcaatccttggcattctctggcttgtagttacatgactccattctcttccttcatcttcccatactttatccactgtgtgtttttctaaatatccacgttcttacaagcacactagtcatttgataagggcccatctgaatccacttaacttgattgactaggcaagattttatttccaagtaatgtcatatttacaagtactgagagttgggatttgaacatctttttggggaagacacaattcaacccacattactcacatcccaaagctccttaccatgcacgcatctccagtcctttggtattcaaagtgtgatacacagaccagtagcaccagcatcccctgaaacttgtaagaaatataaactctccagaccacctgaatcagaatctttattttaatgtgaaaccttggtgatttatatgcaaattagaatttgagacacatacccctcaaaacgacctgcctacttttcttattatttcatctgctcctcactccatatcactctgtcattactctgcttgtgtcatattggcctttttgatattcctgtagtgcctggactattccttccccagatatttgcatgggttatttactcatctgcaccagatataaagatatagttattatatatagtgatatataattatacatatgttatcacacatatataaaacacagtgcagttgttcctggttaatctattttaaatatacatcctatcaaccccattcttcttccttgctttttctaattcaaaagtatttattttcacaaatttttatccacagctaaatattacagtgactattccaagcatttttctataaagaaaatctgtagtttacagatttgttcaaagtggaaaaatattttcatcagtagtctttcttccctggtgttaggttcacccctgaatatgttctgaactcttccggagaggcagtccttcatctaaatgtcagtgggtggcaaaatgttatattcaaatctggattattctgacacagtgtcacttcagaaagtagcttagtttcatttctggttgatcccctttgttagaattaggaatttaaaaaaaaaatcttttgtatgtaatgatctttataataataataaatcctgccctgtgtttgtcattggcattaacctctgtctacaccctctgattctctaattatggctccagtgggtacaaaaggtgaattatggttatttggctcatgcagcaaattaattggagaaactgatgacaaatagtctgtgaagaactacaaggtcttgccccatgctgtcccattttagttaccatttagttatgtaggcattacacaaatgcctcaaattaggacacctttgctgtctcagtaggtcgagtgtatgaaaatttactttatgcagaagaaataaattctaatttattggttaccagaatcttaatgtatgaaggttctaagtaaatatttgatgaattgatggtagcagcgttaatttttaaatgttccaagctcctagttttttcgttttgtttttacaaaagccttaaagtttggtactaaggaaatcaaagaatcaactaccaccatcatgcttcagggaaagggaaaaatgtctacctttgggtctaatctgcctcccaggcgagcctacaggtactagaactctaactgcaactatgatggcacagggaaaatgcatgtatgtaatatgcttgtcggcttcagcaacaactcatgtatacatacacatttactatatgtaaacaggtcccgtataatacttaaaacacaagtgtttgatctataaatatttgattcttagtatttaaaatgcttctaatgttttaaaagacaaaactccaccatgatatcacattgaacattaaaattattcccacagcaacacttttttcagagaaacaattgagaagtcagttatcttagtcaccactaaaggcacctggtgagaaaagcctgaactaaattttaaatattaaaaaattaaagagacatctagtgcagagttcaaacctttatgttgaattgtttaagagtcattactgatttcatgacgctgataagtgtttgagatgaaatgattttttaaaatgcagagaaaatgctaacagaatattatatagttcccctaaagatgcttcttctaacctccaagtattaaataagattgatctaaatgttaagtacatataaagtatatatttgctagtcatctataaattttaagtacaattccagtgatatacctgtatcttttggaagagaagaactaaacctgccgtttcttaggctaagtagacaattcataaggtccttccttccccatttattctgattgccaagcttttgttcagtaagctcttggcatctagtgattaaccagtgacagcagacagtagtgttccttgtgttccatatcgtatttgccatcctcaatgtcttccaggtgagttttgcagtgcaggactttcaggaagattttattcctgtaggacaaattaatgatagaaacacaaacaagagtaggaatggggaaggatttcagcccagaggaagcctcagctctaaagagcagtaataatgagaattcaatgagatggaaagaacacattcttctgatcctatggaacctcatgctttttatcacctacattataatttagtgccatttcccagtctctgctaaataccctgattacaccagtaaaaggaaaatccccatttgtctaagattatcttgatgcagtctattatctcctaaatgaaaatcctgtctttgtgaggacagggattgcccttttcttgttcatcactatacctctatgcctgatagagaccttggtacagagtaggttctcaataatcatttgaatgaaataaatcctatgtaccacatagcagcttctctggaaacatcaaaaatcaaagaacgaatgtcctgtgaatgccagacaatctgcttgattgtactacaatgcaaaaaacatcttctttgctctcctgcagcacgtaactaattacaatgcagaccagtttgttagaagaaatataacagaggtatagatagcaagcctttaaaccacaaagaaggaagtgattaattctgtttcacccaatggagaggtgataatacaggaaaaaacctgcccaaggattgaggccactgtgagcttgtgaagaggcagaggctggaggtgcacttgagatactgctttcaggatgcttgtgccaagaacatatgaaccttaatttctgttactgggcctgtgtctccaagttataaagttcatatgtaatgaccttcatgatatgcctcatttggaaggaactagttatcccaccccatagccaagattctcatcacaactatgtgaggaatattgtagacacaagaggtgtataaatagcataaccaacaggacctccagttctcaaccaaaggaaaatgggaaaatagaaaatatcctcctaacatcataacatttagagtcccttggtgtggaccaactgcctctcattgaacagtatcatgtactggactcattccataaactcagatagaaaaagaagtagtacaaatttaacaccaggttaatagtactttctcttttgctggacaatagactataattaaaatgcacttctttttaatctttttttctcagggattattcagtttactctttggatgcctctaggatctgaaggtaagagcaatgacagtttcatgtttctagaaaagcgtgaagtgcttctggcatgttgaagttacgatagcttctttttaacaatgcaggtacaggaagctttgctgaataagttttcattgtcgagatggtcttcaccacactcaaaggtaaaccttttctctgcagatacttttcgttttataacctcatgtattccactagcattctgaagtacagagtactaaattttttcttcaggattttgattaattaggctaaatatattgcatcctcaaacccatctccctcaacagctatatttggcatagatcattccattgtttttgcttctcaagtcattctgcctattaaacagagccatagagctgtcattgagatgctactccacatatttaaatagggtttaaaataatatatgatataaactgaaggttgaaatcaaatgttcaatgagaagcagtcttctggggggattcaaggcattagagaaaacaagttgaagaataataatggataaaattttctatagttcattgtggaacataactattgcccttggatatatctgactgcctttcacatgtcagaaaatactagaagcctaacaaacaataaaacttgtatttgacagttatttttctaatacagatgacaagattccagtattttaatgtgacctctgggagtgggactagagatgccggcagtgaccactagagggtggaaaatcaatccttctagggatgtaaacagctttggtcccacaaatttgctttgtgattttccctttttttctctcttctagtcaacatccctgggttcatccacacctgtgttttctatgagttctccaatatcaaggagatttaacagtttgtttggtaaaacaggtgagtagtggcctctatgttctccctgcttgcccagaacacatttggtcaaatggggagcctcaacacccctactctttcaccccaatcatggcatttacctaaaatgtcctcttttggggtagaggttaaatagaggaacttacattttcacaaatcaccaaaaagtgggtacagagggcagctgcctttgttgggaacttataataactcataaagaataagatttggagaatctagacaatgatttggagagctgtctgtcaaactatcatccatcaaaatgagaactgtaaattgctggccttgtcaaacacagagttcttctcaaattatgtcaaataagagtagataggtgatgtttcagggttacggggcagcaaagaatacagttagaaaatcttactacaggatctcactatttaggtttgttttccttttgtgttctttttataaagtgtgcttgtgttacacatggaagcacatagaagtgtgcatgcattacataagggatcaccctagttagctattctattagaaatattcacagttaaatttctaccttggagatttgaaatgaatggaattaataactttgggcaacagatctcagctattctagcaaattgaaacccctgtcccatgccaccatccctcccccacaggaaaataagccccaggatttcttctagctttttgaaactcaacagatctcacaaatgcagagttgagaaatgtatcaatgttccacattaaggcttttcatatacaagcaaattttgtgaatgcctataactgttaaaactccagaggacttgggttcttttctgcttcaatttgatgaattacccatgaaactgggggaccttcacttctgattatgaaagtcccaattgggcatgtttgggggccccataagtaccgtaactttggtttatgttgtcagcagcccctaagatccccccaggccatgacggaaactttgttagcggtggtggcggttcagcaatttgatggtagggtgggcacttcaacccttttcttgcccgacacacactctccacgcactccctgtgcacagtccccacctccccgcagacacaagcctgtgcagttgctcagaggctgccttccttgctgcactgattctcagcagttctgttgacgttcctgactcctgcttcttttctggtcctgccttttctctccctataattttctcttttctttccctttactctctttacaaacctccactttcagtagagcctccaggtgcctcccaagagcttctgtaagtcaccacaacccaagaggaccagggagattccctcatgcagatgttcccagaccatgcacgtgatggcatatggagggcttcccaccttgacatcttcccgtcctttgtagaaacctggctgctggtatgatgtgaagtagtgactgcttgttggctgccacacatgcatgagaacgacaactctgttagttctctggcatttctagctcttgggaagagggcaggtatgggttggtttccaggcatggccgagtttacctagtgcctagaccactgctcccctgggtcccttaggagatgttcacaccccaaagttcatgatggcttgtcttcaaggctgagttgctgctctgtttttcaggaacatataatgtttccaccccagaagcaaccagcttatccctggaaaactcatccagtgcttattcgttgctcaactaagaacaggataatccaacatacgtgacctcctggggacagtggatggatgtgcttttaaaaagagatccttgcaaagcaatggagaatgtgttcttggggcaggtttccaggagcagatgtcaaaaagactttcatagagaagaggctttcttttgtaaagacagactgaaaataattgttatgtttatgtttgttccctccccctcccccttgtgtgataccacatgtgtatagtatttaagtgaaactcaagccctcgaaggcccaacttctctgtctatgtaatatagaatttcaaagagacattttcacttcctacaaattgggcacaaagataagctttgattaaagtagtaagtaaaagacaacctaggaaatacttcagtgaattctaagaaggaaggaaggaagaaaggaaggaaagaagggagggaaacaggaagaaagggaaaaagaagaaaaagagaaagatgaaaataggaacaaatatagacaaacaacattaagggccacgttttaagatttccatgttaatgatctaatataatcactcagatagtgcaacattgagaatttttttttaatggctcaaaaatggaaactgaaagtaagtcatggggaatgaatactttgggcagtgtcttcctgatgtcttcttagctaagaggagaaaaaaaaggctgaaaaaatagggaggaaattccttcatcagaacgacttcaagtggataataatatttataagaaatgaatggaaggaaacatgattctcctgaggataactttgtatgttaaggtttgaactaagtgaatgtatctgcagaggaagtattataaagatacgtcattagatccaagtgctgattaaatttttatagtttatcagaaaagccttgtattttagttcgttccatattttgaaagcaaaaaatatatattttatatacctttcaattgccaaatttgatatatcgcactgaagacagaccctgtcatatatttaatggcttcaagcaggtacttctctgtgcattatagaatagattttaataatcttatagcattgtacattattattgctgttgtcactgttattgttactgtggataatggcccttggtgtgttgcatagctccctaggtattctctgtttccatctttactttcccagaccaatatacattaagaattttgcatggtctaacttgtgtttattccaaccacttggaaagctcctgaaaagaaattttacatttggctgttctgtgctcctaatgacacttgaccttgttgaacaaatggcagagactttcccaaggatttgattgtttgtgaattatctgcatgtgtgctttttttcgtgtgtatgtatttcattaaaaaatataaatacttatgaaaattgcatccatattagagttaaccatgtgctatggatacagcaaccctacattgcaaataaaagtctgatcccaaaaggagaataagacaaaaatagagatgtggggctacttaggatatgtgggctgtgtggcaacagaaatgggcccagccattaggaagatggggcaaaagaggctgagattcaacagccatttctttattgaggttcaaaggagttttcttttaatattttaaccctttaaaatatcttctttttatttttaattttaaattctacttaaattctacttctgcctctcttttcttcatggggaaggagaggtatgggacagaggtgggacagttgatgtaaatgaactctttatttctacatattcacaaatgacatagacatctacttccacatttgcctgagaattgtcacatcactgtcccaaatgaatggtgcattactgaaagtccctaaaggaaatcattgttatgctataaatgcatgccttgttcttcaggaatgatcaactttgggcagagcttgatactaagaagatggagacagaggttgggttgggggaaatcccttgaattagaattagaattagagaaagaaggcctttggctgatttggttcctggagttatatcaagaagaatcgagccaggcttggaacacaatgttagcagggctatcttgacatgatcaatcaaggaaagcacacagtatcaggagcaggatgtggttgtcatgttcaaaaattcagtgggacaagaaacgctgaacttccacccacttcagccaggatcccttggggaatcactgtgttcaaccctgtgaagggaactttcatcgtagcaggagcctgtgggagttacacaggatgtggatctggcccactgctccattcgttaactggggcatgttcccttatccccaacacacacaaatacacacatgcacacatgtgcacatgtgcacatacatgcatgtgtttcaccctttcaagccacatacatgcatgtgtttcaccctttcaagccacagcactgggtccaaattccagaaaagctatgaaagcaaataattggagaaacacttgctggttttctgcccactgcaatacaagttagcccagccactaccctttcccgggaaaatcctaaaatgaacagtagaattcaaaattgtagaacagcagttatgaagctgagaattttatgaatgcaggagcctcatttggccctgaggttgccatctctcaatcagtaatgattacaaggctattagtagcagattcctgagaatgaaggcacatggagttgtgcgatctactttgttcgtaaggtgcccagtgcttccctgtgttcctgacatctctcagtgtataaagtccattccctgagcctaaactttcttgcattaagagctttccattaagtcagtttcttgcaaagggctttgtcctaatgcgtcagagtctgtgaggttagaatattcacaaatgagaagctaatacagattataggaatattctctgggaatattctaagtccagactaacacatcatctcttgagtaagccagatgtctgctatcctcctcccccacttcttattgtttgcatggggaaatggttaaataaatgtctgtggggttttcaggtttttgctaaggccagaaattaagaaagactgtgggaagtcacggccttttgtggtttgtatagagaatttcaaagagatccatgttggaatgcttcagagaaaaaaaaagttacatggagctgagaaagattacagtaattagtaagtatagaaaggacgtgtgggtgagttattgaggtgaatggagcaggaagtcacaatcatttgaagaaaaaaagaaataggtggtcctagaaatgccaggtaggtggaatgcgtttattttgtgccatgtgatggtgaagtcaaataagccctcctcatccaaaagagaaaacccagtgacccaggccagtaaaagactgattttttaagtgtccaaaatgaaggtggaacttacagggaacttacctcttgatagcgtttttaaaagggcaaccggaatagcatctcatcatttcgagaggacagtagtttagctttaatattaggttctgttggtttctaaaattatcacttgggatttaaaatcacatcatgtataccagcacacaaatatgcttcctttccatactataacaatgaaatatctaatgagatctcgtgagctgtcttatcgggggacctgccccgataatcacataggttcttttctattttcctaagtgtcgactggcttgagaaataaaaggacagagtacaaaagagagaaattttaaagctgggcgtccagggggagatatcacacattggtaggatctgtgatgccccacaagccacaaaaaccagcaagtttttattagggattttcaaaaggggagggagtgtgcgaataggtgtgggtgacagacatcaagtacttaacagggtaatagaatatcacaaggcaagtggaggcagggcgagatcacaggaccacaggatggaggcgaaattaaaattgctaatgaagtttcgggcaccattgtcattgataacatcttatcaggaggcagcgttttgagatcaaccggtctgaccaaaatttattaggtgggaatttcctcttcctaataagcctgggagcgctatgggagactggagtttatttcacctctgcaatctcgaccataagagacaggtacgccccgggggggccagttcagagacctacccctaggtgcgcattctctttctcagggacgttccgtgctgagaaaaagaattcagcaatatttctcccatttgcttttgaaagaagagaaatatggctctgttctgcccggctcaccggcggtcagagtttaaggttctctctcttattccctgaacaattgctgttatcctcttcttttttcagggtgcccacgtttcgtattgctcagacacacatgctgtacaatttgtgtagttaacgcaattattacaaggtcctagaacgatatacatcctcctcaactgacaggattaagagattaaagtaaagacaggaataggaaattacaagggtattgattggggaagtgataagtgtccatgaaatctttacaatttatgtttagagattgcagtaaagacaggcataagaaattacaaaagtattaatttggggaactaataaatgtccataaaatcttcacaatccacgttcttctgccatggcttcagcccgtccctccatttggggtccctgacttcccgcaacactgtctctgtagtaattgtttgccttcttgcaatgtggtgctgctgcctctcaggcttccgcatgtcacccagaatgcagctctattctccaaacagcaaacgatcctttccatcttccaggtatgggggaggccggcagctcgcccctgagctcaactggctggcagggctgatggcttccctcacaccatccgcactcccaagccgtgtgcaaagatccagcacgttatagaaggtttaaacaagggtccttgaagtaaagttttcagaaccagttgtctggcgaacaaacagatgcctgttccaacatttgtgtgaggatggcttgaaattttcattgacagctgaaaatagagccctcatgtcctatagattaatataaaggatgtgagggctctatttatcctctagcacattctagacggaaaccaagtttcccactgttagtggacagaagaagaaaagaggggagatgggccaactcccgaagtccgctctatgccagacacaagttctgatctccaaatatcatctgtatgtgtctggggtgggcgtgggggccttggtcgtggtgtcctatgattcagacacaaccgtcctgtctattcttttttttttttttgagacggagtctcactctgtcccccaggctggagtgcagtggcgctatctcggctcactgcaagctccacctccagggttcacgccattctcctgcctcagcctccggagtagctgggactacaggcgcccgctaccacgcccggctaattttttttttttttttttttttttttttgtatttttagtagagacggggtttcaccgtgttagccaggatggtctcgatctcctgacctcatgatccacccgcttcggcctctcaaagtgctgggattattcttaaatgattttatacacacccattttcccccttttacctgtaaactttgaaatgaagttgaaaggccaccagtgtccatgacaggtccctctgcacacatggtggcatggttaggagatacatgagcctgttcccaccccagggtttttattctgtcatgcagagccaagtgaaggatgccggtgactattgaagcctaaacagaacaaacccaggagcccggggggaaaaatggctttattctcagtatgaaaggcaagaggacctgattgggcaagtggtgggcagattgctgtcacggcccacttccgatgacattaaacaacaaaacccaggaatgactttggaccctgcctttttcggattttgattggtgccatcctggttcttccatcctgccagccagccggcaccccagcagttgtgggaaaaggaatttgactttgattaactgagaaaaactgtgcatgcgttttctgttttttctggaactgtgagggttttcctatgccccaggggctccctcacagctgtcctatcccaagcattcccgacaggaatctccagctgggttggagtgacagctggcttccagcaccgcagctccgcaacccctgctggcgtctcccgaggctcgcgcgcccctggtgggcgtgagaagaggcgtccccgcggcggtccggcctcaggaagcccgtgggaggcagagtcagtcccgcggatgacgcgcccagtgggctacgttcaggaagtcatttgatcatatgggcagagcgaaggtcaaggcatagtggataacagaaaccagaaatgaaaaaaatctctttcactcccgcctcctaactttcatattatgatccttacaggggaaagggtagtcagaaagccacgtaggactgtggagggagggaaatcccagtcacgtcgtttcagtgtgtgaaaggcaaaggaaatttcgggcccccaatcactatgcaaaaaggaaaaaattaagatggaagctgagccatgcaagaaacagccttttccttctattgctaagcaaatagctaacagatgaaaggccagatatctccacagagagctacactaggttcaccttttatgtaaagtaccgatttactgagatgaatacatcactgactattttcctacctgctccttttctcctgcaatgcatggattatgccatgtgaccataccctccctctttcgcctccacttttcccctttaaatactgaaaccttcaaaatatctttgcagaaagacacagaccacaggctgtctctgtgattgtgtgttccattattccaggcatgttcttaaccttggtaaaataaacttctaagttgattgagacctgtctcaaagactggtttacaagtgtgcatagcacatctgcaggcaggcatacatttctgaggcatactcgctgagatagctccttcctttctctgtccccctcttactgactgaatctcatttatggcactaacagcaaagctgaaagccccagaaaagatctggttcacccattccagataggctgctggaaggtcgtttgaggaagaaaaatgggtgccttccatatttcatgttaacccaatactttttccatcaaggcagctgcaaaaggattaacataggtggtcctattccctttcctaattcatccattgaaagccactgctggcctggagtttcattttcaatccatcatgaatctgcagatgaatctgcagctatcccagggcaatctgacagtccagccagcagctgaggctggatggcaagttcctatcctctgagcacacattgctaacgtgtgatccgagaagacccaggagaagtcaacagggccaactgccggcagggttggtccttggtgtagagggacaagctgaactggccttaagtaatgaggcagacagcttcccagtttggggggatgtcacgcaccttggcctgttgctcctataccctcggaatagctctcacaccttcttcttcatgttggacattccttttacaaaaacagaaatctcaaagacagataaagttaagaaggttaatctcaggttaatctcaaggagagaaaaggtatgcaaatacacctctgggtgagaaacacagtaacttaaatttaccctcgaatgaaaatggctggtaactatataactatattaaccaacattttttgagccctttctgtgtacctgctgctgttctaagatttttatgcgtataatctcatttaaactctatagcaaaccaaaagtaactaaatattctttttctttgcatttttagaggaaaaaactaagcacagagaggtaaataacttgcccacagtcacacagctgaggaccagtagaatcaggatctaaatgcagtgtctgacctagaacatgggcatgtatccaccaccttatattgcttctctatgcaacctgatgccagttacttgcttaaaagtaggcttccgtagcaggaagagtttcaaatgcaaaaaatgagagggagaacaacagtgacagagaggttggaggagttaagccttctccaagcttcatctcactttataattctaccttggggcagcccaggacataatgaccaatgttctgggcaaacttcagagtgcgcctacttcctttttaagtctctggtgaaacatcaaagaattcctgctgtgctgctttattgaaagtagatctcaacttagttatctagtggaccccccagcttgagtcttcagtcaagtgagcttcttgtaaggtctcaatcaccagtgttgtttttatttttgtctcagatctatcaagaattctcggcgtgttggatggcatttagacatgtaggaaggcaatatggcttcccagaaatgaagcgtgattctgaggctatgtttaaacatatcaagtggagaattgggacatttgtcctaatacgtttagctaagtcatgattttccttctgatatgcagactgaaacagcagctgatttgctacttgaatgctttgcattctctgcttcattttgcatggacaggggtattgggctgttcttcagcattgattgacagccagtttggcaaatgtggtatggtggttaacagcattggttctagagccaaactgtgtgcttttcagttgtaggtccaccacttcttagtttgactgttggtaaaataactctttctgcctcaatttacactatgtgaaaggaaataataatggtacatgctccatgggttgttgtaaaattcttataaagcctacaaaatcatatctggcatgcaattattgctgaataaagttagcctttattattttgcatcttactgtgtgtgcataaaaactatagtagatatatatcatacacacatatatacatcatgcatcatgacttagccaaatttattagagcaaatgtttcaattctcctcctgatatatttaaacacagcctcagaattacacttcatttctgagaagtcatactttcttcctatgtgtctaaataatatccaacactcagaattcttgatagatcttgacagaactcagatttagatgccagttctattcagaatcaaactacatatgcctttcacattgtcacttttaattcatggttaagagcttttgagagtaacgtcaaaggtacgtgacatcctaaatcataactttatcaaggtttgagtttaaatcgtgctcattatgaagccagaatgggtgagtaattcacataacaagtgtgtgagcctggttaactaccccatgtctgcatttcaaatcagttttggtaatcttacatattacataattttatttaatcttcaaactaatttcattatttcttttctttacaaatgagccaattatgcactataacagtggtgttaattaaggctttctcagttacaggtaacagaaccacaatcaaattagtttaagcaaaagtgggcacttaccacgtaactgggaaagatagtagattggtacaccttcaggtacagctagattcaggtgcccaaacagtgttctcagagttctggctcttccttttgtgttgtttcctctctttgtgtatttatttcattccaaggtagatcttcaaggagaggaatttatgaggtccacagaccgatagattgagatttaaaaagaagactaacccttttcttctccaaatgttcaggtatatgtggcagtacagggtatcatgattggcttagtctgagccatgtgctggccccatagaaataattatatccattaggatcatgttttctgtgaatgccagacattcaaaataatagcgacttaaagtagaagtttatttctctaacacagataagcagcccaagactggtgtggcagcctggctcggtgcagtcctcagaaatccagatactttctatttttttaatctgcttttgccaaggtcaccacgtggccccatttggcagctctcactctggccattacatccccttatcagtcattaggatagaagaagggactacaggtgtgcaccaagactcctttaggaaaggttcccagaagctcacatgcaacattccttcttccattccactggcctgaatttgatcacactacctcactgtatcagtctgctttcacgctgctataaagaactacctgagactgggtaatttataaaggaaagaggtttaattgactagcaattctgcaaggctggggaagcctcaggaaacttacaatcatagtggaaagcaaagcggaagcaaggcacgtcttacatggtagcaagacttgaaaagtgagagaacaaggaggtgtgccacactttaaaaccatcagctttcatgagaactcactcactatcacaagaacagcatgggggaagccacccccatgatccaataacctctcaccagttccctccctccacacgtggggattacaattcaagatgagatttgggtggggacacagagacaaaccatatcacccatctacctgcaaaggaagcaggagaaggtaaactagactctgagtagccatttgaccagttggagtttggggattctattactgagaaaagaagaatggatgttggtgaccatttttgttgggggctgatatctgaacatctcctctgcctcctgctctcttctcatacctttcttatgaccccatttttctattctccttttattctcttgaccagataggatctttaaatgtttttaatgattttcattgagctggtgagccacacatgggtcaatttgtcctaaatttgtctaggccctgagggatgctgtgacccagatgaggcccatgtctcaatccattctgggattccaggactagtccttggtaaaattgtggaaggcaaagagagatgggtcttgtctttactctgatatcactgttagctgcaactcttacacacacacacacacacacacacacacacacacacacatcctgttaggctgccttacccatatcaaatctttcctatcatattttttcacatcagtactcattagaggtcactggcacctgactccattatctcccatcccccattcattagggttttcaagagtctgctaaatgacactcacagctacaggataactataaatcttttcaaacttttctttgcttagagacttttgaaaaacatacttatattaaaattggcataagaaagatgttttagccatatttataaacatatagaaatttgagtaggtgacaaatcatccataaacctgatatccctaataagggaaaccaagtaaaaaagacctttacatagtgttcaatatagatttgcctatattttatagcaccttccaaacctctaatcttattaaggttttctgtagtcaaacaagaataatagattctgctattaagtggctctgtgacctgcctaaggcacttagcctctccagaattgcctcagtttacccaaatacaagaggtggacttcagaatctctaaaaatttcatcaagccataaaacagatgatataattcatgagaaaggaggagctcaagaagggaaggtgtgagatcatctgtaatttgcttgtaaatgtctccatataggtattacactgtatacagcctgcagggggactataatccacaccctgggggaggttaaatagtatgcaaagtattctgaaaaggaatacacactccaatagcagttagttagtatttgaaagatcctaatcaaaagtctctactggagaaatatctgttgcaaaactttaagtatttctatagcaagctataccagagggtttgttattagtataaaggatgcttaaaataatttttgcattggttaaatacaattatcaagatagctataggtacaatactttggcaggcccagtgaactaacttttggggtagaacctttgactagaactctatttggtcctagttttcactcacttaatacaagttttcattggctcatccaactagagcagtgattcccaatcagtaatgattttgccccttgggggacatttgtcaatgtcttagagatttgggattgtcactactggggaagtgtgctatgagcataaagtaagtagaggccagggatgccactaaacatatcacaatgcagagaacagccctcacagaaaagaatatccagctcaaaatatcaccagggctgaggttcagaaaccctagggtagagagttgactgatcctggccttcagattatttgaatgcatgtgtgtagaatgaacctttaatccaagaggcttggtggtggagcacttaaaaggacagagcagagacttccctacacatacaaaacaggttggatggctatttgtgggtttgttggtttatcgggggaaccagactccaatatttcaatgcaagttctttctattttccctaagtgttggctggtctgagaaataaagagaaagagcacaaaggaggaattttacagctgggcctctgggggtaacatcacatattgggaggtccgttatgtcccctgagccacaaaaccagtaagtttttattaggattttaaaagcggagggggtgtacaaacaaagagaaggtcacaaagatcacatgcttcaaagggcaataaagatcacaaggcaaaggcaaaattagaattactgatgaggatctatgtcccactgtgcacatactgtcttaataaacatcttaacagaaaacagggttcgagagcagagaaccagtttgaccaaaatttaccaggctggaattttccaatcctagtaagcctgagggtactgcaggagaccagggaatatttcagtcctcatctcaaccacataagacagacacttccagagcggccatttatagacctccccccaggaatgcattccttccccaaggtattccttgctgggaaaagaattcagcaatatctctcctacttgcacatctgtttatatgctctctgcaagaagaaaaatacagttctattctgcctgaccctgcaggcagtcagaccttatggttatcttcccttgttccctgaaaatcgctgttattctgttctttttcaaggtgcactgatttcacattgttcaaacacacatgttttacaatctatttgtacaatagtggtcctgaggtgacatacattctcagcttatgaagataacgggattaagagagtaaagacagacataagaaattataagactattattagggaagtgataaatgtccatgaaatcttcacaatttatgttcagagactgcagtaaagacaggcataagaaattataaaagtagcaattttgggaactgatacatggccatgaaatcttcacaactgatgttcttctgccgcagctccagctggtccctccgttcagagtccctgacttcccacaacaatggttaacaaatatgaatgtgtagcagaatttagttcaaatcttgattcattttaacataatcagagagggggttagagttcccatccacttctaattatcagaggctccagatattactgaaagaacctgacatttgtgaatggccagattggctcagctcagttcacagaaggaaaggatgcagatggggatgtatcaaggatatggtgtgggaagcatgagacattttcaaaatttcaagccactatgacttattcccactatgtaagattaaagaagtcagacactcagattcagggaggatttcccacatttttcatgttgctcatctaaatcccaaattccatactgcctagagattatgaaatgcttaatttctacccactccccatcctacatgcccactttgccatcaccatcccaacacctcaaaagaataaagtatctgctagtcctcctggaatgattgagggtttgggctcaaagaaaagctgaataccatgtcagatttatggtgagccagatcattaatcaactgaggtgaccattaatcaccaaaagtgataaagatagatagtaggcatggtactggttgagaatctagagagaaataaatatcaaaatgctttaccctcattctggtacctccttatcattattttgacctagcagttttaatttgcagtactagatgaaaatactaggttatctttgaaatttgagcttctgcttcttccagagagaaactcatatatttaagaaatgttgtcattggtttgggctagggacctttccatgtgagacagaccacagcatgttccttttaataaaaccaaaggacaataacagcagcagcagcaacaaagcctagagttcacttctgaggtcagatactcagcagagtgttaagggcatagctttctttaggcctaactatgaggttagtggagggtttgcaggactgtgaagcacagcgagaaacaaagctggaatccatttccaatctggactttggagataatacaactgggctggtgacaggatagcttcctatctagtctgaacattgaatagtaatattttcatacatattaaactctaagataggttcatattcattatcccattgtattactctgctactctgtaagtagtaaagtcatgtggaaggagatagtcagctattatttccatttgacaagttagtaaactaagatcaagagcttaaatgatttcttactaaaattacccagccagctggatgggcaatccaagcctgcagccaggatgcttggcttccagacttgttttctatccactagagcagtggttctcaaggtgtctgtgaggtgggggttgtgggggagtcagtagcagtagcagcatggcctgagaacttattagattctggcacattcttataccttgttagatcctggcacatttaagaatgtacattcttagatctcaccctagatctactgacccagtttctacagaggacaggaagatgtcaaggtgggaagccctccacatgccatcacatgcatggtctgggaacatctgcatgagggaatctccctggtcctcttgggttgtggtgacttacggaagctcttgggagggacctggaggctctactgaaagtggaggtttgtaaagtgtggggccctgtaatctgttttaatcagtcctccctgggatacagatgcacctcaagtttgagaggtattgccctcaggggtgctgttttcacttgctacaaattgttctcatacctttgcattaaagaaactcttgttaatctctcattttgtttccagtgcattttaactctacaaaattgtcataaagtctctacttaggaaaccttataacttaaaggaccactcagaatccttaaaatatttttgtttgttaaatttcctgagctgactcattgctgattgggtatagaaactttagctttttttttttttttttttttttttcacttgatctatcttggaacttccttgccccagctagatttttatctccttaggaactatggaaagaaagcatatctaaaaatacttctttaaagttctctgataccttctgtttgttaatatgataatgttgtacataaatagctataaaatatactgttaaacttaaaagatctgggaaagagcttttgaacacccccaaccttcaacacacacatgcacacccacacgtacatacaataccagatacaaagaaggtgctaactcaatatttattaaatttattaaagggcttctcttagaatctcagaggaaagcaaatgctgtgaagccgggctgcctggaagtacctttatttgaaatctttaacaagatcttaaaagagtaatgacagtactgtgtctaatgaaaaatgagtatttgattctaacatattcaacataagaatttcataatatatatttgatctgcaatataaatgagagtttctatatcttattcattcatttattgttttattcattcaaccattgttgagtgcccacaatgtgccagccatgcatctaggcacgtggccagcatggtcaataacaacatgtgcctgccctcatggggcttacagtctataggaaagacagtcaatcaaacaagtggtttacaatgaagtatgatgaatgttgtcacaggacacactagatacattaggagcacatagcagagtaacagaattatgtggggcagaaagatgacaagggtcacacatggggctggaggccttagaccttggaggtcctatccaaagcaaggctgacaaaaaagctgccccaaactgcactgaccattggaaggtaaggcctgcatggaggaggtgctgctgtggtctggccaatgccaacaggcaggtcacttccttggcctttgggaaaggatggcaatgatggagaaggtcaagaagatcacaccagccgtgcctccaatcaccatgcccaggacgctgccgtgcaactgcatggcctgacagcgctcccatttagaagaaagcatgtccagagatgcacctgagggaaaaggacatgaagagagtgtgggaactcccaggcctcaggtgcctcctagcaacactcatctccacagcaataaaaatggcaaacgctcactgagcaggtccacgtggtgcctggtcccatttcaagtgctgtatatggaccaactaatttaacccttcaacaacttttgaggtggaggctattacttggccattctcatcatcttcatcttacaggaaggttaaataatttgctcaaggtcccattgttagtaagcatttcacacttgaaatctaatcccaagaggtatgcctccagatccaggcttctcagccacctaggattcaggaggatggtctgagacacttaaaggaatacattgcctgacactggctaagaatacaagctacaaaggaaattccccagatacagtctgacttagagcatcagtggtagcttgaaaacgtctaaataatattaaataaaatgttactgtaaggttagtgtgtactgtcactatctcacaaggttgccctgaagttcacctgagataatgaggacactgtacctatcaaggtatttgacacagagtaagcacataatggccagcccttagttttgtttcttaatgttatctggtataaagacgaattaatctcataaccaaggcatataacttgtagtgtctcatccatacctttgtaaaaattccagcctttgtttcaaacattcccactagaaggtctactcagcagaattctacaaggcagagtgaaacaatcagaagtcagcattttctggctgggcatggtggcacacgcctgtaatcccagcactttgggaggccaggtggatcacctgaggtcaggagtttgagaccagcctggccaaaatggcgaaaccagcctggccaacatggtctcatctgtattaaaaataacaacagcaacaacaacaaaaatagccagacatggtggcgggcacctgtaatcccagctactcgggaggctgaggcaggagaattgcttgaacccgggaggtcgaagttgcagtgagctgaaattgtgccactgcactccagcctgggtgacaagagcaaaactgtgtctcaaaaaaaaaaaaagaagaagaagtcagcattttcttttactaatcctgaatgattttaccttccaagtcctcatctctatcctgagaattgacttcttagaaatcagtgagtaatagcaagtttatttcattttttttctgacccagtcccctccaaacacaacttcgtaatatcccctactgttatcttagaaaaacttattctgccaactctcagctgcaggtttctaggagaggaatagtttggctgagtagaggctgacatacaagtggcaaccctggcctcccttagcctgggaaggatgaagcgtgttgggggcacacaatggaatctggcatctaaggacctgtcaggcaaagatatgaagacccatggctttggagcccagaaacagatgggccttccccagtaaaaggagccagagggcttcttggaagagtgattgattctatgggtggggcaggaaatataaaagatgagcctagagcatgctatggtgccagaaagtaacattgtgttcataaaatctgatgttgaaagatcacaggagccaacctggaagagctcccaaaggccaaagctgggacaatagaagcaacaaaataaattatgaaatcattgcaacagagcccactgaatcaatgtttatgattcctttgtgatatacataaacaatcgcataaacaaattaacggggtgaaggggccattcttctttacagaagaattctaattaatgaatgtgaaggacataggaaatcaacattagaagatcccagtggtgagtattgcagcaggttgtatcaatagatgctgaaattagcatgtgaggatttgaggaaaagcaggatgtctcaatggtcttgaactatctctcccaagatatgtatcaattacagagggagaaatggtaactcttcagtggagaggcctggtggacatgctgttggccagatgatgaaggttgacatcaccagtaatgacatgtatcagcatcatgtacctgctcacatgatgcaacaagaaggcacagcacatatttactaatcttgccacaaatgtgaaacctcaatttaatcatgagagaacaagatgaaccaaaaaaaaatccctaaccagtaatcttcaaaagtgtcaaggtaatgaaagacaagaaagaactgaggaattgtcccagattggaggggattaggagacaggagacataaaaactaaatgtaacgtgagatccggaattggatcctgaaatagaaaaagaacattagtgggaaaactgggaagagccgaataaggcctgtaatttatttactagcattctaccaatgttcatttcttggctatgctaattgtactatggtttgtgtaatatgccaacattacggaaagcagggtgaatggtatagagaaagcctctgtagtatttttgcaaggtatctgtaagtctaaaattattgcaaagcaaaagctacaaaaagaaaaaaaaggagactaaaaagaactcagaagaaatgtaaatttttgaggtaggcagaatagctcctacatctgctactgttcaaatggaactgttgcttctgtcatcacatacctccttttgtgaaacagtttttagggttttatgcaagcaaacattgtaaaaagaactattaaagttctttttaaatatttaaatttaaatatagcaaactgtactgctttttaatatttaaacattaaatatagcaaactgtgctgccagacagacctagatgcaagtcccagcttcagcattttccatctgggtacctttcagataaattacttaacctttctaagcctcaacttcttgatacaccaaatggggataaggagagcccttatgtcacaggtggcagtgagaatgaatttagatcatgcgtgtaagatgctcaggagaccacatgatgcataacaaggggtcagaaatatcaggtgttcttactactattattgaaaacataactttaacaatagtgcagtgtaaatgacagactgtataactaataatcattaggagctaataataacatctgcgtagtcagcaaagatttaagcttggtcttgagacccactgtcatggagtagaaagtccctaggctagaagccatcttggatgttgttagagttagaaattccaacaacatccaagatgctgttgacaataccccagaggaggaaaaggggtgaaagtcaagagacaaggagacctgggacgcctctgtcctggcagcgtaagcccatgaatccagggcacacctttgtagagtcaaggaaaactgcatccagctgaccatctgaggtagtcttcgccctactctgcaaacagcagcctttaccaggcataagcatgcacacggcccaggtctgctggcctgcctgtctccccagccacagagcctacctgcacctcgccacccacttcaggttcacacagatgccatcattttggcaagggtttgggtcacatgggtctctgaagtactgtggccagttatggtcctccagggggcctgtgttcttcactgacggcttctgtcagctgggctgcccctggctgaggctgacaggtacggcttcctctaacatggcctttcctgaaccttctttggagacctgctgctcctggccttggagaatgaggccttgggggctcagtcttttgcctttagtgggaacttcagtctggctgaggtgggtgatatcttcaggaaatagagggtcacgaggaagatccaggattagtaactgactacagcgaactcccacttctggtgaaagttccccagcctgcttctatctctagtgatatgtcacccccagtgacatggaaaagtggctttgaatccagctgattcccacggtactagctagttttattttaaagtaatccagtcacatttttatttattgaatttgcaaaatgaagcataaagttagcatggatagactgatggaaactaaattgaaatcagtgaactgttacctctgataaaattttcaaaaagatgacactaaaatttcagtttctttcagggacagttaaaataaagatgtgcgtccttgaccaactgaagaaaatgtggttctcctacaacacattttttttaacctcatccccaccctccatgtgtgctttaaaatcaggataaaatcagtagagtgccaagagcataggattatttactcaggaagaccaagaaaagtactttcaaagtccacaaacatgatgaggtcatcatttttcaggaaactcctccttttcagcatttggtgggagatgaaaccactccagccaaagtcaatgcttctaaaacaattacagtcagcatgataggttcccaccctggacggcctgtcccagatgacagtgtcatttgtccctgcaaaattgtaggtaacataaaatcacattacctctttagacttcgctttccagtttgtcttttatgaggatacagggctttgtgaatcagaaaaaaataaataaataaaaataaaaataaaaataaaaaaatgttggaaaaaaattaagctatttactctttccaggagaattgaaattcagaattgaaagatgggaaaggcagagaatcacagctctgagtgatcagttgtctgctactgcgtgatttttttaatgaaaagagagggacagctatggcttctttcttctgaggcttaggtcttctcttttgaaaaaaaaaaatagtgccaggtgtggtggctcatgtctgtaatcctagcactttggaaggctgaggcaagttgattgcctgagctcaggagttcaagaccagcctgggcaacagggtgaaaccccgtctctactcgggagtctgaaataggagaattgcttgaacctgggaggtggaggttgcagtgagccaagattgcgccattacattccagcctgggtgacagagcgagactccatctcaaaaaaaaaaaaaaaaagttttcccatttctttactgatgtaagtttatttcatgaacatagtgatattgagtgctattttaggagtaagtacattagctctgcacagagcctagcaagttccgagtatttgataaatgattagcagtatctgtttcctcaatcacaacgagctcaatgaggcagggatcacctgattcacttgtattgtaagtacctagcacagagtttggcacatggtaagccctcaacagatgtttgatgagtgaatttaggaaagggaaggaggatgtgatggcattgaaaatcttaacttgaaactccaacacgcctatgttatcggtattcccaggcggacaatgtgaggagaatgttactctttcttgcaccacagaatcacatctgtgggcctctctggttcgaggggcagttcttatttatgccgacaccacccacctggagatatgtgcaacttggaggtagtgaacaccaaacttgaggacatcctgttcctgacatcaggctcctggtcgaagatggtaattatcacctgtctgttttctaccggccactccaggatagcatcattctccccactgcacacgtgaaaagcaagtctcaaatagccagagctttctctgccatgggggtataaagttaacccaaaaccgcatccctctgaattgtagaatcgagggctctgaagcttgtccccttcgctggtgttctcaaggacctgggagaaattccggactgtccagacccctgtggggcagggggtttctgtcagagtgatgtcatccaggtaaattcccccagttgagttccgagggtcgccttttgtgccctggaaaagttagcgaaatttctgttcctctttgagtaccacatgggcaattttccaattatggtcatcatctcctgaggacagagaacaaggctggtgagaattgtggccaacacttaatgagtacttattatgagtgtggcacagtgccatgtgctttccataaatgatctcattaaatccccacagcagccctataaaataggtactattatgaactggttaagtaacttttccaaagttacatatttaataaggaaaaatggttttttaaaatactatgatttattttaaaattcacattcaaatcttaaccatgaatttgttttccactatcactataagaatccaggttctgaatttcctcctgagttggctggttcaactgtaacccctaatgttagcaatgaaagcccattaggctgaatcgtataaaatagccattttgtaagccaaaagtcaaaaaataataactccatatggtcccacctgtcacttgttgccagagaggtataaggaatgctgaagagcagataataacctgtaggactgactggatcttccctacctgaaaccgactccctctccaacatctagacttttttctcttccttatattatctgaaagttcagcatgtagggcagtgaagtaagccaaagagagtactattgtctagaaattcacattctaataaagattaggtctacttgctttttctctgagcatgaactagaagtgggacttttgaattaagagctgaggaaagatggtgagaaggctgttctagagcatgggatcctgggttgaacagcagaagaagccaggcaggagcttgggggcactggagagaggaaactgaaagcagagcaactcagttccgcaaagagatgcgcctacactgatatttttgcacaggacattccctagagttgggcttgaagaggagaggaaaaatgcttccaagtggaagtcacgttggctaaactgagttcctacagatgagtgtcttttttccttcttctgtgtcttttaaccagaaatctactgacagaactatactttccctgaaacagaaaagacctttaatctccctttgttttcagaccattctctctaaggacttcaagggacaggtataccaatgttatgtttcctagggtggagctgattatggcctgtgtggttaggttacatgggaacataggagagaggtagagaaggcacacgaccacctctgtaacatacaaatctaggtagctgccatctcctggggagagcactgcaacctactggaagacacatggacttgaagggtaataggtgccagaaagtctaggaataggaacagagatacagcatttgaactatttatccagcaggttatagatgacgggaattctgtcaagagaataggattccgttcctgctgatgagtacctgctttgttttttcttaatataggatgtccaaatgaggttgagatgggggaatttggcactgggaaggagacccaagagggtcacataaagaacactaagtgatattcaactaacctttttgaaaagtttcattgacaaaccagtatcagaacagactactttaaaaatcctttcatacagtgttcccagggacagtacacaggcatactctgaattcaatgaaaacacaaagcacagcagtgtaagaaactaatcatgggatgttcgcttgattttatgctttgaagtaacactgagctttagatgaaagtgagtgataataggtcccatcaatattattgaaactctaactcatttgctcattaaatatttacaatccttggtaacataacacatcctcaactcttaaagagtatctacctgtcatcctttcatcatataaactatgataaatttcaaccagaaaagtgaacccctcaaaactgtgatttgtagagttcccaggcagcccagagtgccttggatataggcgatttgggaacctgttcttacaagtgacctctaaggaaggtttctccttcaagagcagcagatatataaaaaataattcctttctctggactcatttcaactgataaatgccaaggtaggcagttggatgctaggataatctggccataaatcatgattcagggttataaacaaagtgtatgctttattttgttgtggtggtggttccttcataactaggaaaagggagacaagctttcttacttttcaacaaaaagtttctctatctataatcatttacatgctgaccttcttatataaatacacaaagtgactcttaggaacatgtaaatgattataggaagttaacatataccaatgacttatttgccaccaacattataagtaggcttctagttactgcagcatattaaataatggtatcatttgtttttctgaaacagatgcaaaacactgtggtcaattttttttttttaagatggtgtcttgctctgtcgccaggctgcagagcagtgatgcaatcttggctcactgcaaccacattgctaccactgtagccgagctgtggtctctgatgtcaccaccagctgcagcgaggtaagccacggaggcgcaggctctggctccagcctccagcatgcagcggtgtctcttccttctcctcgtcttccagcccggcaggagaagctcccgctgctagcctccctcctaccgctccgtcaccaacaccaccaacagggaggcagcgccctaggctccaggctccaggctccagcgggtgaaaactaatggacccttctagttctctaacccaggtacctagcagctgagcacaccgacacagaagacccaaaaatgacgcaccacttcctcagcatgctttatatactgaagttacggatcctggactacatgttctgattggatgagagaaaaacctctaggcctactctgattggactttattttcatgctgtgattggttatcttaagacttgctctcatgcaatcagaacatgaagtctaggaaccggcatgcgcataacctccgtatataaatgatgctgaaaagctgttacggttttttttttttagggttcggtgttttactgttgagctgctcagtgcccagcttagaggaccaggaaaaggagtcaccggccatatgctggaggcttgagacacggcacagcggcgcagctcgcctcgctatggttggtggtggcagtggagcttgcgattgccacgcggctggaggggtaggaagaggaaaatcgttttgggatagatagaggggtgggtaaagagtttggttattgccaaagggaaaaaaggatagcgaggaggagaaggcgttgcaaaaagacgatggggaaaagatggtggggaaaaaaggttttgggtagatggaggtggaaagacagggtgtggagcgggagtgagggaaggttttgcagaaagacggtggatagaaagtttatgggtggatgaagggggaaaagatggtggcaattggggaggggagagagtggtgaggtgggggaaatgggctagcagtagggagagagggttttgtgaaaagacagtggggagagaagtttttgggtagatagaggagcagaagaagatagcaagtgggagaaggaaaaagggtaactagcgggaggaagacaaggttttgcgaaaaaacagtggcagaaaagaaagatggtggcgaaaagacggtaggtaaaaagtgtttgggtagatggaggagggaaagagggtgacgaggaggagaaaggagggtggcgagaagggagcagggaaagaagggtgggaaaaagacgggaaaatagtttgggatagatgcagggcaaaaaaaagggtgacaagcaggataggggagagaagaggacgagtgggaagagggggcagactttgtgaaaagatggggaaattttggggggtagatggggggaagagagaggtgagcaggagtggggagaaggctttgagaaaagatggtggggaaatgtttttgggtagatggagaagggaaagagtggcaaggaggagcaggaggaaagacaatgaggaaaacagtttttgggtagataaagggggaaaagagggtggtgagcagcaggagtagggaaaaggctttgggaaaagacggggggaaaatgtttttgcttagatggaggaggaaaagggcatgatgacagcaggagggggaaaaaagagggtggccagggagaagggggaaaatacggtgggaaaaaacgggagaaagtgtttgggtagatggttggggaaaagcgtggtgagcgggagaatagagaaggctttgcgaaatgacgggggcgggggcggggagaaaacgaaatgatggtggggagaaaacggtgaaaacgtttgggggtagatggaggaagagaaagggtggtgagagggagagggcgaaatgcggtcgggaaaagaaggtggggaaatggtgggggacaaaagttttgggtagatttttaaaaataagattatttgtattttcacttttgagtagtttgagttctttagatattttgtgtattaacctcttgcctgatgcatagctgcaaagactttcttccattctcgggttctgtcttcattatactgattgcttcctctgctttggaaaaggttttaagtttaatgtaattacatctttgcttttgttgcttgtgcttttgatgtctatttgaaaattccttgtcctaaccaatttcatgaagcatttatcctatgttttcttctctggtagtttcatagtttcaggttctgtatttaaatctttattttgagtagatttttgtatatggtaaggtaatggcctagatgtattcttgtacatgtgggtgttgggttttcctagtacagtttattgaagagattgtccttcccgaaggtgtgttcttggggcctttgttaaaaatgaattgaccgtaaacgcgtgaatttatttatgatttctctattctgtttcacttgtctatgtctgtctgtctcattcgttcatctctcttgtctctcccccgccccttttattgagagtaccatactgttttgatagtaccatccttactataaatttgtagtatattttgaaatcaggtagtgtgatgcctccagcttttctttttattccacattcttttgtctatctgaggtattttgaacttccatgtgaattttgagattctttttctatttcaatgaagaatgtcttgtaattgaacatagattgcattgattctgtagatcacattgggtgatacacatattttaacattcttctagtgcatagagatgggatatctttccatttacttgtgtctgctttagtatctttcatctatgttttatgaagttttcattttgggatctcttgcctttttggttaagtttattcctagatatcatttttttggtaatgaaatagctttctcgatttctttcttagatatttcactattggtgcatgggtgtagtattcatttttatattttgatactgtatcttggaacttgactaatttattgtttctagtaggttttttgtggaatctttagggttctctctatatatgttcatgtcacctggaaacagacaatttgactccttttttccaatttggatgccttttattgcattctcctaattgctctagctaggacttccagtattatgatgaacaaaagtggtgtaaaagtagccacacttgttccagatcttagaggagaagagcttttaacttttccttcttgattatgttagctgtgggtttgtcatatatggcctttattgcactgagatatgtgtcttctgtactcatgttgttgagtttttatcatgaaggaatgttgacttttatttttttcagcgtctactgaaatgattatatggtttttgttgttgatttgctgaatgtgatgttgcatatttatttgtgtttattgaatcatcctcatattcctgggttgaatgaaatccacttgatcatggcagatgatctttttattgcattgtcaaatgcaattttcaagtattttgctgaggatttcttacacctctgttcatcagggatatttgcctgtggtttcctttttgtgttgtgttctggtctggtttttgtaccagggtcatgctgtcctcatagaacaagttttgaagcctttcttcctcttcattttatggggaatattttgagtaaaatagatattagctattttaaaaatgtttggtaattcagcaggaaaaccatgattcttgtgtttttctttgccaggagactttttatgactgctttaattgcattcctcattattggtctgttcaggttttttatttttattttttatcattctatcttgggaattcgttatgtgtctagaaatgtattcacttccagatttttcaatttctttgtgatgtttttagtaatcttttaatgcttcgtatttctgggttaccagttgtaatgccttctttatgactttgttttctttttatctaagttcatctagttaaaactcgtcaattttgattttttttaaaacaccccagcttttgtttcattgactttttgtattttttgtttctatttttaaaatttcttctctaatctttatggtattttttctgcgaattctagcatttgattgttcttgtttttctcattacaggaggtgtactgtcaggctatttgagatcttcctacttttctgatgcaggcatttatagctatacacttttcctcttagaattgcctttggtgcatcccacaggatttatgttgtgtttctattcttacttgtttcaataaatatttaatttcccttgtatttttttcatttcttttattggttgttcatgagcgtgtattttaatttccatgtatttgtacagtttttaaagttctatctgttactgatttctaatactattcgactgtggtcagaaaagatacttgatatgaattcagtttttaaaaatgtgttgggtgaccgaggcgggatcacgaggtcaggagatcgagaccatcctggctaacacggtgaaactccgtctctactaaaaatacaaaaaattagccgggtgtggtggccggctcctccggaggctgaagcaggagaatggcgtcaacccgggaggcggagcttgcagtgagccgagatagtgccactgcactccagcctgggagacagagactccacctcaaaaaaaaaaaaaagtgttgtgacttgttttttggcctaacacagtctgtcctgtagaataatcgatgtgccactcagtagaatgagcattgtgcagttgcagagtgaaaagctgtgtaaatgtctgttaggtccattctgtatagagtacagtttaactgatgatgttttgttgtctggatgatctgtccgttcgcgatagtggggtgttgattacggtggagtgttgaggttactctattattgtattgcagtccctctgtcctttaaagcctgttaatatttgcatctatatttaggtgcttcagtgttggttgcatatgcacttaacggctgtttacttgtttctcattatataattatctttattttttctttttttgagttaaaggctattttatctaagtatagctactcctgctttttttgtttccgtttgtatggaatatctcttatcatcccttgactttgtctgtgtatgtctttataggtgaactgagttccttgtaggcaggacataattgggtcttttaatccattcagccactctgtcttaatttaatttacattcaggattattacagataaaaacatactactgccattttttacttttttgattgttttgctttttcttttgttctttctcccttcctcttttctttctgatctctttttatttcttctctttcctccttgcctttcttcctgtctttatttgtagtgaagtaattttttctggtagtgttttaattccttggtttttatgtttagagtgtctgttgatttttgttttctggttaccatgaggctaaacaacataacaagttactttaaaccgaagaaaacttaactttgattggtctcagctactcaggaggctcaggtgggaggaccgcttgagcctgggaggccgaggttgcagtgagctgaaattgcaccactgcactctccagcctgggtgacagagtgagaccatgtctcacaaaataaataaataaataaaaatgcaatagctttataatgaattctgattgtaaatttggagatgatatattaaggtataaagaggaaagtgaaaatcataatctcattacccaaggataactacttctaatgttttggtacatacgcttcctaattcataatcccctctcttttacacacacacaaatgtacacgtaaaatagactttacacacataaaattttattgtaacattttgagaaacacggttttgtaattttttctttaaaaatattgcagataagttctgtgaataacatataataacatacatcttagttttcagattttgttttttgctcttttgggtggcaggttcgcttttggctaaaatgaatcgtctcagtatctttgattttccttctctcctctaagctgttgcttttggaaggggcgcctggatctccctcctatttacttgggggcaaacacatagtatcaaggggttttgaagacacgttgcctgtgccagatagcaacactggctgtagttctgaaaatattagcgtttttgtcctgtgattaatactaagatgtaaatgaagtggtttagatcactgtagcaaatgacctagatataactgtgtgtgtgtgttttagatcattgtagccaatgatttagatacaactctgtgagtaccttttaattaagggctcaagatttctacacagtatgttcattgtctgctttatttgtagaagtgtaaaagctgatacttgggtgatgtaagaaaatggataggttttactatcacaaggaaaaggtaatatccatacacttttgccaaggaggcatgggttacttaaattggcttctggatattggagtttgggtatgatagccttacgttgaattttttggttactgcttgataatatttatttcagtaattgtgtttagtaattgattgtgtgtgttaatgaacagtcctgtcctaaaagcaaaaatgaagtggttcaagggagcatgaattgttaacatctcctttaaacaaataggctaggttaaaatttttttacagagctttacagtattacatgtgagtttattacactattacatgtcaataaaaatggcagcagaagctctcttaactgacttgccagatggattagatctctccattcactcaataaaatgtccattttattgagtcttaatccattcagaatccatttagaaatactatcttatttaacctgtaccctgtttcaactagcaactggattataagagatgtgtattaaatattttagaagacagattcttttaaataaataaaaattatcacacaggctgtcttaaacttttaaaaaagagatctgattttagatttggttaaaatactagcctacattagtattctttctaggaaataaatattcacataaattgtttttccagaaattggccttgaatacagatttcagatcgttgaaaacggaaccatttgaaatctgcatttcctttccttttcctaatttatttcagtcgctcaataggattttctcatggaattaacttttccctctcagcgtagttacataagcttgctgttgtaatcatgaaaaataattacccatttcagcacttactaacgtggaccttacttgaagggtctctggttttaaagtcagagcacatggctagaggcagatgaagagtacttcatcattcatagccactgagtctctataatttttaaatgcctttggaaagctagatctcatactcaaaagcatgcttttgtgttacaaatcttttagtgaactacttactcaggtcataatgcttttaaagccctgtttttctttcctcagaataaactgaattacatgttaccaataacaatgccacatcatttcaaaggaaactgaattaagtaatccaagtccgggttgctgaaaactagatgacacagggtaggcactgttttggttaccgtgcaaaggatctctattagtcagcttgggctgccataataaaataccatagaactgggtggcttaattttctcacggttctggaggctagaagctgtagatcagggtgctgctgcttcggttcctgatgagggctttcttcctggcttataggttggctggcatcttgtcctcacatggcaaaggggagagtactgtagtctcaccttgtcttaaaatgacaccagttctatcagattagagtcccaccccatgacctcatttaactgttagtacctcctcacaggccctgtctccaaatttagctatattagggattaaagattcaacatataaattttgagagggcacaaacattcagtccgtaaaagaaactagttgtttaattaacaaggattgttgagccctgatatcttgttatacctgcctgtgtccttcccccattcccctccactctcatttcctcaaaaacactcagataaggatttttttcagatactgttattgttacttatcaaactacgtagtaacattatgaattataaatgttattagccattgagaaagtagctgtgcactgactgaccccaattgactgggagggctagatggtgccttctctgtggtggaagataggttggagaaatgtggttggtagcaaatgctgtctgatttgaacagctttgaagaaggctggttctagttgatttcagttctctccagatgccatttgaatctaaaccaattttctagttcttatcattacagaattgtcttctggaacaattatttctttttgttacttggtagcaatatggatgtagttttctgaatcattaaggcattttaactcatcttccattctcttattttttaagtcctttaggttgtttgagggacattcatcaaggaaaccggagaaacttaaaatgctcttccgcttctttggaacagtcacagagaaaagtgaactcctttcattcttgcagtaatttttcttgctgatgggaacagttcaagtcaagtgacatgtgaggaacattttgtgtttaacgtaaaccttcctgtcccaactacattgaaacagtaatgatgcgacaaggtaacttcggttttatgcttgtgttgtgtataagcataaatgtgtgctataaatgtaggggggcggggtttacatactctgaaatcggacacatattctatacatcaaaacattttcatgaataaaaaccagagaaactatattgaccaggaaataaattttggatgctctttatttaaagaagcattcactagtttatttgtataagtcaactaacgcattgcttttctacccattcctctcttttgtgcccccctaagccctttgtggagttctcataaaactgttttgtactgagttttatatccatcttcctctattgaaccttaacattcttgcttccccaaaacctgaaagcagctgaggcagtaatagtaaatgtccaacaaatactggtaatgaccaactgataatagattggtattgccactcttatctcagaagctgaatgaccgtggtcaagtttcttgacacctctaagcttcagttttatcacctatgaaataatataataatggttattatcttacagggtagttatagatattaaacaaggagatacatgcttaataaatgtaagctattatcaatgggtagcctttcctacaagtggatgtaaaccagaacaccttaaaagtttctttgtgctaagtaggtaatgtcaacctggtcaagtgaaatggctttttttcagttctgggttgtaggattgtcttaaaacatgtctttgaacaattttaaggtcatttttctcatatccttcttttactcttgcatgacagtgtacttggcatcttcccccttgaatgtattgctattggacattgttaaatttttagaatgaaatcaattatcaggattttaatatttaagggaacattatatgcttctctgatacggaattatttatctcatagcttattgaatttcagttttgtgccctgtactgaatgaaatattaaaatgcagaatcatttggacctatgagacacaaaatcaaattagaatttgtaatgacttgttaaaaagatgactacgtaaggccaggcgtggtggatcacgaggtcaggagttccagaccagcttggtcaagatggtgaaaccctgtctctactaaaaaatacaaaaattagccaggcgtggtggcaggagcctgtaatcccagctactcgggaggctgaggcacaagaatcacttgaacccaggaagtggaggttgcagtgagctgagattgtgccactgcactctagcctgggtgacagagcaagattatgtctaaaaaaaaaaaatgactacttttttttggctattctaggtctaagtagaattattactgttggtcttttttgttttgtttttacagtactttgagttgccgttttaagtagaattgttataactaagtagtacagagtttacttttttgtcctgggagtcaaatcatgtatgtcttctctaaaaactaacttggctttctacattttaggatttcagatactttgaggaaaaagctaaaagtttgttttttaaactagaaatgtatatgccattataagtatttggaatttgaagaaataaattataactagacattttattttctgacttttttactgtacatgttaattaagttctttgtagaaatacagtacaacattgctcttggtctgcagtatgtaaagctaacggtttaaagaggaaatcctaaagagaataaaagaggttgcagtataatgagtcgttgtgtagaagttctggagcctactcaatagactggagaagcttatttaaggtaccatatttcatcgaatctaagatgtcatagattatttttaaaaagtgctattacattatatacctctaagaagggaaaaacactcaggacagggagtttagtaggagacctaacccacaaggctggtacacctagggataaatgagaaattaacttgaccatccagaaaagggaccataaagaagcatgcaagtctcaaccttgacactaaatagagaaagaaaaaaacatttctctgagaatttgaaccacaagccctaagctttgggtgtgcagccttaccaccagtgtggtccacaaaggcctgccacaaaggattaattcagatggtgttgggctgatagtgttcccagatgacagcagaagcagatgcacaccttctctgggaaaattctcctctagtctagacctatggtaagatacctccattataaaagatgtattccagtttcagaaatgtagtatgtggaaaaacccgccttttagaattgataaaatagaattccatcaggaccaacttttcagtgttgttaaacgtgtattttatatttgatgaggatcttgagactgaaatgttttaaaaagccttctgaattaaattactttttatatagttttagataaagtatcttatagatcagatttttgaaaatttatgacctgtatgtagtatatattgtgattttattatgggaagtatttgattaatcagagtatcctattctgagatgaaagttgccttgttatgaaaaagaaagctaacagacatgctctcaaggcattttttgttaatctgagaaaccatgttcttctgccttttcttgctttgccagcagtgtttacgaatttctcttagcatctcttagtatatatgaaggacatttggtgttcttacttctctgctaagttaccgaatgacaagagagatgttttctattatattcatggaattgcatctctagtgttagagttgtttgaccacttactcgtgagttttaaatatgttatccgtttatcttaaagttagatatctaaagaatgtaagacctatgttaacaaaaaattttgttttcttctgcaactgctccgtatggtttttgagtggttcctgcttttgactgagaacaaggaaatgtggaattgtgcataggaatgaaatgatggccaggctttcactgggttatacactgtcatcagtaatagttcctgacatctctctctttccttaagagcttttttctattcaagaaaacagaaatggcatagcctttttagtttgctctttgatttgagtcagacaaattacttctggccagctgatatatttgtttcttttgctactagctttaaaaaataaataaatctgactagaaaaggatctcatcctcttaaaattattgactacattaatactactccattttgatcctcccaaatgtattgcttcttgaaaaatatgtcatctttattctgtaaactcttagaaccagtaatttcttctctggctaagactgctactaacaagtagagtgattgcccactatctaagcctgaaacttagctttactaacttcagaggatgtgcaaatgattttctttttaaagctgtggcatttcactttactacaaagtacataaatgtgtctttattcaccagtctttgaatgtagggttaagtcctttctttgtaaaggagtctacaaatttgaattcagttttgtctttactgcataagctgtaccagttatacatcctttttttcaatggttttgtttttaaaagtgtattcagcttcaaaactttaccaaaaagtaccagcactcaaatcctactgttgtgctgttatttgtatagtttcgtttagtgaagtcttactgttttataggagtttctactgtaaggataatattttcaatcaatattctgttattttccaatgctaggctttgtatttcctggttagttttatagtcaatgttagacctattcttttatcgagtgtgtgtgcgcgcgtgtgcacgtgtgtgtgtataatgttttcaaaattgaaacttattttgggtatgtttttcttttattgcttctgtagaacctactgggttggtgacatttacaagacagagtcttgaggattttccagaacgggaaaggtaacaataataataaaaataatcctagacccctagaattagaaggactcttgcactatgagaggattctattttagagcacctggaaagatggttttccaacctctatcctagtgccagggaatttcttctcagaagtgatccatcgatagctttcatttttgaaaaggttatgccttttaaatcaaagtctgtaaccctttgatttctaccattttgtcttggttttgtcttctgaaagaaagcggtgtttaaaattgaggagtgttgtatgtgaagacactaataaaaggaacgccaatatataaacgtttctccttaccctttttttggttagtgtttgaactttatggcttttctttctggaggacaagattgagaaaagtctttttattatttacattttagtaaatagtaaccgtctagagtttgagtggcaagaattttgaagtttggctgcccttgtgtactactggtagattttctgcaagttgctatttactgtttgtttcttatttatcagaaaataattgaggagatagcagccaatctgagctaattcagatttgtaaggtccttagtgtcctgaaatagttaacatattttttaatctaaagcaagtcccccaatgcacttaaagaagtgtggattaactttttaaatatgtttgaggacatggtgaagcatactaaacacatatttaaccaatgcttcccattttcactttctaataattttatgatagtttgtaattgttttgtttggaattagtgatgaatggaaatcacttaaaaaaaaaagttgagaagtcatatctgcttaggtggctttcctgcggtgttttcatccatcaaagatgtttatttgtgaagtgaaagataaagaaatttactccagaagactgagtgtatggtttaggtgattattaatagagggaagtagataaaaggttaagaaacctgaagagagaaaaaaaatgagccagaaaaagatgagagcatgtacagcattttggcatcatgccatgtcagatctgaaaggaaccccagccgcctactaaaactctcgatagctctgtaatacctgcaacagttggagactggatagcttcagtgacggcaaatccgctgttgcacatcagtttgttccattggtggctgcttgtgttatcatctcatgctttcattcactaaaaatgttttctacattcattctccactattcctggttcttccttctagagctatgtaaataaatctgaatttctagttttctttaagatttgaccttccttcatgtatcttaatggcttcttgacctactttcctctccaaaagtgcatacaagttcatactaaactgattcatttcttctatttcacatgtaatatggagtctaaaccctttatctctgctcttaacagagtagattggttgcagtttcttgggtgcaggaatgaaaaaatgagtacatttgcctcagcctcccatatagctgggactgtataggtgcatgccactacacctggttaatttttgtattttttggtagagacggtgtatcaccctgttggccaggtttgtcttgaactccagacctcactgcctgccttggcctcccaaattactgggattacaggcataagtcgctgcgtctggcttgggggagttactgttgaagtattgtctttgtatcccaaagcaggcccttctgaaactgatgatgttgatgaaaaactccttctactgaagtctttgcaatgtataatcttttcacttccattttcctacatactgtttctattggttccttgtattccacagactgtgttttagtatttataagtatagtgttccttttctatgtggaaaagggaaaatgtattggcctttttttaacatataaatgaacttcacaagcaacaatttttcaaatcagttttccctgttgtgaatctcgaagtgggtacatgatgcactttcccatttaaggtaaagtacacatttatcccttatctcagaacagtcagaagtcaagttcttattgtatggttagtaatgcaaatattgataaggtcatgtgaatacttagtatttagaagaattctgaaatagcacttgttactctgtaagttttatgcatttattactttttttgaattttttataatgttcccaaacttgactgccttacttctatctcttctggcctcaagtacaacaagatgtattttctttagatttagcatataatataaattcaattgtttattttagattttgaaagaacaaagaggaactacagaatcattgcttacattgacaccggccctgttgtcccaatggatgggttttttttggatgaacgtcaaaattgaccctgctgttaaagcttgaaacttggatctgttgtatctgagttctctcctcaaaaaaagaccttcaggaagtatcagataactgaaacataccagatcacagcaccacatgcctcctgcccctccctaatttctgttctcttatacattgttaaatttttttcctgcccctattagtcaagcccatggatttgagactgagctcccagctcctgggccgcagcaccaggttaaagctttcttccttggcagtacttgtcacctcagtgactggctttttctccgatgagcaggaggacctggacgaaacccctagtgtttgggtaataacatgaacgaccatcttaactgttattctttattgaaattttactttttaactactggcctcttgttcattatctcccattcttttgacttcatatctcttttttcattgactttacagtcaaggaacttgatgctccctaaatccaaatattacggttaaaagaagagagaggaaatgtgtgcagagaaagtgtattttacaaatgaattaaaggtggattctgagttacaggtttatagatttacctagagttttgagttcaggtgagttttcacaatatgcagtaagtggaaaagaatcccaaaataattgtgacatgaaaaagctaggtgttgaaaaccaaaaagatttcactttggtatggcacttttaattcaagaatactagccaccaaatgagtttttctgactgtaatcattgctctttaaaaattgagatgtatttataacttttgtttgacttttagtacagcttctgaatttagttatcaatagataggacaaaatagatgagcatctgcttcccttccccctaaacaatgtattcttaccgaaatgtaatatatttttatttatacttgaagacagtgtttttcaatcttttccatgttagtagctcagatctttaaggacagaggatgtgtactgggggcagtttgtggtcttaatcctaagtggcactctgatattttagattatttctttcatatttgtgagtaaaacttctgctccagtaggatgagcctgtttaccttgtgactgcctaacagatctgttgctttatatgccagtttttagaagcaggcagattacgttacttggattaaaatgtttttgacactaaaggtagtatcttaaatttttacatatgagttactttaagtacaactttgcttaaattatggggatcgagtttccataactttcaccatagtgaaaatggaaagcagggaacattccacagcaaatcctgaacttatttacagagttaattgagcaaagcaggcattcacacttgtgtgtgtgtgtcagtgacagatgagcatggtacttgaagcataattgtgctgcttcagattccaatatccagtaattttatcatgtagctagagtaactaatattaagtccccaagcctacttgggtctactgtatttgtattttaaaagaatgtttttaagctaccaaatagacatgttatatatttcttctgaattagaaaacgttatttggattaatagagttaatagaatcatattttatgtttattatgtcttttttttttttttcctgagatggagtttcactctcgtcacccaggctggagtgcagcgacgcgatctcagctcactgcaacctccgtctcctgggttcaagtgattctcctgcctcagcctcccgagtaggtgggattacaggcccccgccaccacgcctggctgatttcttgtattttagtagatatgaggtttcaccatgttggcccaggctggtctcgaactcctgaactcaggtgatccgccctcctcagcctcccaaactgctgggtttacaggtgtgagccactgcacctggcctattatgtcttaaaagtgcttgcatcgtcacctagattattttttatctttcaatgtgagtttttattggtttatatgttgtttgttttctttttaggaagccatcattctttagagggcaatgaccaaacagtaccagcagaaattgaagtaccagcagaaggctaagaaggttaggagaaaaagacattttgtattttactgtttttttcttttttttttttttagacgaagtcttgctctgtcaccaggctagagtgcagtggcacgatctcggctcactgcaacctctgactccctggttcaagtgattctcctgcctcagcctcctaagtagctgggattataggcacagaccaccacatccagctattttttgtatttttggtagagaccagggtttcaccatgttggccaggatggtctcaatcttttgacctcctgatccacccacctcggcctcccaacatgctgggattacagatgtgggagcttggccacctcctcttgggagaaatgcactgattctggttgccacgtggatttattttgggagtgatattcatctaacttcatggaaataatactagatagagaattcatccgctaactttctatctgatgagagttttgggcaaatcgaataccaagttaccaagttttgtttttttctctgatgcaaaaaaacaatttgccagccagtgaaaaactctcacagctctggatgtgagtttaggatactggatttctaccattcaatttcttactacttttcttgcacagggatcatggcacaagctgcagtttccaccctgcccattgaagatgaggagtccatggcagatgaggagtccgttgaagatgagtccgcagagaacaggatggtggtgacattgctcatatcagctcttgagtccatggtgagaccttccgttctaacattctgtaattgggtagtactgggtggtagataaggttgatttgtttttgtagaatttataattttatgatttatagttctaatgagtagatctttttcttgaatagtagttatggtcaaacacttctgaccaaatgtgccatgttgtccagcctggtctcaaaatttggggctcaagagacctgcccaccttggcctcccaaaatactgggattacaggtgtaagcccctgaatctggccagatatttttctttttatggctgaataatactctgtgtatgtatatattacattttctttatccattcacctactgatgggcattagggttggttctaccttttggccactgtgaataatgctgctgttaaacgggtgtacaaatacctgtctgagtccctgctctcagttattttgggtatatacacttaaagggtgttggtggatcatataattctgtgcttaatatttttaaggagctgctaaaccattttccacagtgggctgtaccattttacattccaaaaggcaatgcatacagcttccaatttctctatagcattgctgacagttaatattttctgtttatgtactgtatttttatagtgtttgaaattaatctgagggtttttgctgataccaaaatattaggaaaggttttccaaaaataatactgcttattataaagaattttatgtgttacttgatgccctgtgatccattttctcagtaagaagaggaacttctcggctgggcgcagcagctcatgcctataatcccagcactttgggaggccgaggcaggtggatcacaaggtcaggagttcaagaccagcctggccaacatagtgaaacccagtctctactaaacaaacaaaaattagctgggtgtggtggcgggcacctctaatcccagctactcggaaggctgaggcagggaattggttgaacctgggaggcggaggttgcagtgaccgagattgtgccactgcacccagcctgtgtgatagagtgagattccatctcaaaaaaaaaaaaaaaaaaaaggaaagaagaggaacttctctccattcaacctcattccactgcaccaactcttctgtgtcgggttgtgcaggggagaaagggagcttggcacctctttgctgtgttgagttgtggtagcccatcactgggttgtaaagtgcattgcctcctccccccccccctttttttttgagacagagtctcactctgtcacccaggctcaggtgcagtgctgagatctctgctcactgcaacctcagcctcctgggttcaagcgattctcctgcctcagcctcccaagaagctgggactataggcacgtgccaccacacctggctaattttttttatttttagtagagacggtatcaccatgttggccaggctggtgttgaactcctgacctcaagtgatccacccaccttggcctccgaaagtgctggggttacaggcatgagacactgcgcccatccacctcctcttttacttgggagaaatgcgcagattctgggtgccatgtgcatttgggagtgatactgatctaacttatggaaataatactagatagaaagttagtggatggattctctatctgatgagagttttgggcaaaacgaattcctagtttctgagtcttatttttcccctgattcaagaaaactgtgaattatccagccggtgaaaaactctcacagctctggatgtgagtttaggacactggatttctaccactcactttcttactacttttcttgtgcaaggatcatggcacaagttgcagtttccaccctgcccattgaagatgaggagtttgttgaagatgaggagtccttggagagcaggatggtggtgacattcctaatgtcagctctcgagtccacggtcagaccttctgttctcacattctgtagtttggtaggactgggcagtagataaggttgatttatttttgtagaacttacaattttatgattttcagttgtaatgagtagacctttttcgtgaatagtagttatggttaaacacctctaaccaaatgtgcatgtggagtttctacactgattttcagacaatctggatcccaactgggtatcccacaattccatcctgacactccctggagttagtgcagaccccgcaggatggggtctcagtcccaggagtctaccctcactccacatgccaattgcaagtcttgggttgttacatgtagttttgaccgaccagttagaaaacagggtttcatgaccccattgctgggtggaatcatttgctcggacagcttgcagaactcagaaaaacaggttgtttttttttttttctgagatacagggtctcagtctattgccagactggaatgcagtggtgtgatcaaagctcactgtagcatgggactcctgggctcaagtgatcctcccacctcagcctcccaaatagctgagactacaggcccgcaccagcatatctggctaagtttttttattttttgtagagaaggggtcttgttatgttgcccaggctggtctcaaatttctgggctcacatgatcctcccacctcaacttcacaaaatgctgggattatgggtgtgagccactgcatctcaccaatttactttcttttactggttcattttaaaggctatatctcagaaacagccggtgaaagagatgtacatgctgggcacagtggctcatgcctgtaatttcagctctttgggagactgaggcgggagcatcgcttaagtgctcaggagattaagaccagcctgggtaacacggtgaaaacgcatctctacaaaaaggtttttctaaaaattagccaggtgcagtgatctatagttctggctactcagtgcctataattctagttactcaggaggctgaggtgagaggatgagagatggggcttgagctagggaggcataggtcgcagtgagccacgattgtgccacggcactctaggctgggggacagagccagaccctgtttcaaaaaaaaaaaaaaaaaaaccacagggcaaggtgtgtcgggaggtcgggaggggtgcagaacttccatgctctctattgcgcgtgttaccttcctgctatctcccttgtgttcagcaaccccggcattctccaaatctggttgttgaggtcatttatgaaggcttctttaagcaggcatgatagatgaaatcattgactattggtgattaagtcagtcttcggccactatttcttcctggagcccagtgggtgaggctgacagttccaagcctctaatcacatggtttgttcttctggcaaccagccctttttcttaagcggtctaggagctttcagtcacccagtcatctcagtaacatcaccaaatgcattcttactgtggtgatcccaaaggtcttagaggctcttgtgttagaaacctgggactaagaccaaatattcaaacaaaagatggggtcctatcacctttatcaccaaggcctttataagaacttgagaagctctgtgccaggacgaggggcagaaaccaaatgtgtattttttttctttttcttttgaacacagagtctctgtttcacccaatctggagtgcaatgatgcagtcgtagctaactgcagcctcaaccacctgggctcaagcaattctcccacctcagccttccaagcatctgggactacaggtgcacaccatccatgcccagctgatttttgtatttttttgtagagatgggatcttgttatattgccgaggctggtcttgaactctggggctaaagcaatcctttcaccacagcctctcaagtagctgaaactacagatgcataccaccatgcccagctaattttctcttatttctttttgttgtttaattgagggggggggggtctcactgtgtttcccaggctggtcccgaacttctggcctcaagcatttctcctgctttgacctcctaaactgttgggattatggttgtgagccccggcctctgtgtccagcaatcacaagaggtctttataagtgaaagagggaggtaagagagtcagaattgaaggagatttgatggtggaagcacaggtcacagagggagatttgaatatgctttgcttctggctttgaagatgcatttaggggccatgaggcaaagaataggggtggcttttggaactgggaaaggcaagggaacaccttctctctggaacctccagaagggatgcagtcctgctgacaccttgactttagccttaatagacctattttggacttctggcccccagacctgttaggtagtagatttgtggtgtattaagccactcaacgtagggtagtttgtaacagcagcaagaagaaatgaacatgaagccaggggtagtggcccacacctataattccagctatttaggaggctgaggcaggatggttgctctggcccaggagttcaagataagcctgggcaacaaagtgataccctgtctacatgggaaaaaaaaattagcgggtgtagtggcatgcacttgtagtcttagctactagaggcgctgaggcaggacgatttcttgacctaggagttccaggtctcagtgtgttgtgatcgtgccatggtgccccagcctgagtgacacagcgagattatatcttaaaaaaaaagtaaaaagaaatgagtgagcatggcaggaatggggacacatagcaatattaaatagagtggtcagggttggcctcctaagtgaaaattgagcaaagacttgaaggaggggaaggagctggccaaggtactgagggaagagcattataggcagaaacaacagaataaagatgctaagagggaactccgtggtgtgtctgaagctcaggaaagaggattgtcgagcagagagggggagagaaggtaggggaggaggccagggagttgtgggactcagatcagtacagattgtgcaagccctgggaggctattgctggggctttggcttttatgctgtctgagatgggagatgcggaagggttctgagcagagaggtgacacgaactgtctattgatttaaaagcatcccatggtggctgagttgagaaagattgtgggaagatttgggtagaagcacggaggccaagctgtggcaacatccaggtaggagatgatagtggttctgaccagggtcctggcaatggtgagagatggttgattcttgttgagatactaagtaattaaaaaaaaaaaacactactgcttttcctgattatatgaagtatgggatgctagattaaagacatcttaagtcgggccaggtgcagtggcttacgcctgtggcgtcagcactttgggagcactttgggaggcacagatggcacagatgggagaattgtttgagtccaggagtctgagaccaccctgggcaacatagcaagacctcctgtctatgcaaataaaaattaataaaatataattatcatgggatagtggtattttcctgtagaaccagttactctggttgtcgagatgggcagatctcgagggtgggagtttgaggccagcttgggcaacatagcaaggctcctctttctacaaaaaaaaaaaaaatcatctgggtgttgtggtcccaatgagggacagcattcctgagactttttaagtactttgtgtgatggtctaataatcatagccttaaaactttctggctgggcatggtggctcacacctgtaattccagcacttcaagaggccgaggcgggtagatcatctgaggtgaggagttcgagaccagcctggccaatatgtgaaaccctgtctctactaaaaatacaaaaattagccaggcatggttgcagcacctgtaatcccagctactcgggaggccaagacaggagaattgcttgaatccgggaggcagaggttgcagtgagctgagatgggccactgcactccagcttgggcagcagagtgagacttggtctcaaagaaaagttattgtgatatgctgtacacattcacaaattcagtgtctcccagaagtgtgagattcttttttttttttttttttttttgagacagaatttcactcttgttgcccaggctggagtgcaatggtgtgatcttggctaactgcaacctccacttcatgggttcaagcaattctcctgcatcagcccaagtagctcctgcctcccaagtagctgggattacaggcatgtgccaccatgctcagctaattttttatttttagtagagttggggtttctccacgttggtcaggctggtctcgaactcccgacctcaggtgatccacccgcctcggcctcttgaagtgctgggattacaggtgtgagccaccatgcccagccagaaagttttaaggctatgattattagaccatcacacacacacaaagtacttaaaaagtctcaggaatgctgtccctcattggcctggtatgacaaagataagaagtcggtcgtgaaaatttctgaacgtggtttaggacaaggaaccccagtaagattcagagacaacctagaaaattgaaagaaaattttactactgaaatcatccttctataaaaaataatagaagatgtcaaatatgaaaataaaactgtcctctgggccctcaattttctgtgtcatgggagaaggcagacagctactcagcagttatatcccataagaatggataatactaaaacaactgacagcatcaagtattggttagaaagtggaactgattctctcattttcattgtagtttaagatggcataaccacttaggaaaatgtctccccatttcatacaatgccaaatatatacttattttataacccagaaaatccactcttatgtacttaaactcaagaaaagtgaaaatattattacagaaaaaaatatgtatatctgatttgttcgtagcaggtttattcatgatagcctcaaatcagaaactgcttttgtgtctatcaatagtggaatggattaaaaacaaaacaagcaaaggcctcaaacctgtggtatagtcataaagttgaatattagaaaataatgaataatcaataggagcaaaatgatgtgtcacaagcatgtttagtgagtgaacataaaaattatataatttatagtttcacttacataaatggtgaaaacagacaaaactaaccttttgtggaaagaatcaaaaccgtggaagcctctgtgttcaaatactgactggaaatgggcaggagaaaacatgtttctgccagatcttctatatgcctgatgtgcattcactcgatgtattttgcgtatactatttttgcaaataaaactgagataaaggcaaaataactcaagagaagatagatagaaataggtagagttgggatagaagccttcgaagctacccccgtaccttgcccacctggcacaggccgaggaagtcctgggacaatgctgtgagcgacctgagggccgtccaggggagccccgccagcccatgctggcgcctgagctgcccgccgccatctgaatatgttgcaaagacagtgctggcctggcaaccggtgacgccccaccccgacccccacttctacccaagtagtggctacgctagagacagattcctgggcggcagcggttaagtctggcagttggccaggtggccaaaggacgggaactggccgttcaccccatcccagttccacagagaactcaaccactatggcccctgagcggaccttcaggcctggtgggctgtgctctgtgcctgcaaacctgacgccatccaggggagctccgccttcccgcgccagcgcctcggctgctgcagaaaactgcaaaactgcaagttgcacacgggcagagatgacggagcaacccccgaccctccgcgccactcaccctacctgcacacctgccgcgcggaccctggggcgggtgcctgggtgcccaagtcaggcagtccgcacagcagtggcaccagggtgaaaacctgctgctcggtaccatcccggttaccacgaagagccagtcccggcggcccctgcgttcttggaggaggccaagtcagagcaacctctcaagtgggagggcgatgcacttgaccctgaggacatcaggtaccaggcccgccagctcacgcctgcatcggagccgcagctgcagtctagacgtggtgcaccggcagcaagtgactggacactccagaccaggcccgccccgcagtagcgtggatcctgaggccagacccccaggcggcaaaatcaggcaaccggccccgccagcagccgctgtttcatccgtgtggacacagagtgcccagcgccagggcccaggatccagaaagatgtccaagaggagcggaccttgaggccaggtgggctgtgcgctctgcggccctgaggccatccaaaggaagctccgccatcctgcgccagtgccagatctgcagctgcaaaccgcgcgtgtggcactggcagcagtgagggcgggtgggggaaggagcagtccctgactctgcctccatccctctccagctacctgacactagccacacagacttcagggtcagagcctcagcgttcagccaatccgcgaagccactcaggtggccgcggagtgcccttgccagcaccctatctcccttctgaggaggagcggggcgggctgcaaggccagacaggccctccttctcaggccgggctggctgcgcgcctgcgatcctggggctgcccgggcgatcccaggagaaccggcgagcccatcggcgcacgcccagagctgcagccccacctgctggcgcgcgccgccagggagcgtcttctgggagcccggcagcaactgccgtgcaggcgcgcgcccaacggctttgcgaggctcactcggtctgagaggtcggaggctgcgagtgtcgctgctgaaggctgtggtggaccgggctggatcgcggattgtgtagattatagatttgaaatagcggagttggggttggatcggggctttggggttggataggggatttggggctgggtcggccggggtcggggagggggttggtgaaaaggtgacagggagctgccctcgctcaagagccggtggttgggggtctgagaagaagtcaccaatatgaagttattcggcttcgggagccgcaggggccagacggcccagggctccatagaccacgtctacacgggttccggataccgaatccgggactccgaactgcagaagatccacagggcagctgtcaaaggcgacgccgcggaggtggagcgctgcttggcgcgcaggagcggagacctggacgccctggacaagcagcacaggtagcgggggctcagcccggggtgggagggggcccccaggcccggcttccccgcagaccctgggacggggccgtgcagggcgccgggcaccctcggagcggcggagccaaacggactctcagctgttttccatccctcataattccctggctggagcagttggagaatttgagtgatttaactcacaaagttaagcatatacagcgttgttatttttaacgtacacgtttaaaacatggtttatatacattataggaggtgcctaatgagagtacttgttcccctatcaaaaataaccgtgagttgtttcagtgggcgaaaagttctcagataagagagcttacttgaaaaatatttactatattatatatatatattttttcagatgaaaagtatgttttcattttatagggaattcattatattctttttttttttttgagtcggagtctcgcttctttgcccaggctggtgtccaatggcacaatcttggctcactgcaacctctgcctgcccggttcaagcaattttcctacctcagcctcccaagtagctgggattgcaggcaggtgccagcatgcctggctaatttttgtatatttagtttcaccacgttggccaggctggtctcgaactcctgacctcaagtcatctgcccgcctccgcctcccaaagcgctgggattataggtgtgagccaccgcgcctggcctatgttgtttattatatatcataagatatatatatatattactgatatgtatacatatataacacatataatatgttataaatatcagttatatatacacattagatgaaaagtacctcttcattttacagggaattctttcaaatcaaattatcaaacactctaaaagtgggcaaagtacctttttccagatctacaagttacttatatacataggaaaaaatccttcgcatttctggtataagaatttaaactaaaagaggaatgaaacagttttctatccacaatatttgtgaggatgttttatactgctgcttaaagttgctgattacttttcaaagtactcatttgaaaatggtaagtactacatttaaaaaatgtgtatgccctttacccaccaattccattatactaaaatacccttaggaaataaagatacatgcactttatttttcacagtacttattttaaagagaacccatagaatggatcctataaataaatttcagttgcatccataggatggaataatatgtgaccactgaaggtggcaatagatacagaagtacgttgatgtgcaaagatgtattttgttatagctagcaaggagaaaaaattagttaaattatacatacacaaacatactatggtcttgttttagcaaaaatatgtacaaaatataaaatttgtaatttctgagcatttgtattttaagtaaagtttttttcctttttcttatctgtgattgctgcagtgagtacaaaacttctagtaaaagtttattattaatggactaatccttgggaagagaggaatatgaatcttgtgctgatgaaaataatttctcactttctattttttatcattattgtgtgtgttgttatcttctttgagcttttagcctcttcagaagtaaaaagggaatgtttttatctgtttccagattttattatctatatattttattatgtacatatgttttgcttatatactcgttccatttatgcaaacataatcatttcattttaattgtattctttaaaaataaaacaacacatataaataattactattgcaaaaatattgctttataggagtttatttaaaaataatgaactccccaactgtatttatccattctttcattccatttatggatcaagcataacctgagtacctgctatgtagcagacatattctgtcatctctcaggacccgtccatccttaaacacttcatgtttacctgccccgcctgcacaagctgagagatttaaaataggaatattgggacttaatctccttgaaactttatctcccacctttcaaacaaaagcatttctgaagttagaaaatagtagaagataacctttaactgctctttcgaaagtttgtcagtcttaaatactaatattaatcattggaaagtcttatttgcatatattttctaagtataaatattgaatacaatgagccatatgtattcatttgaatcatgagtttcctttggcttcaagttgtttgaaaatcaaagaattaatttgtttaaaaaatgcattattgttatttcagtgctctttccccatagtacctttaagaactaaaatgtatttaagtttcagttacatgcctagaactgccctagacctgctgagtataccatattctacttaatgtaaggtctcatggattgcgtgatgccccgatattttatatatcaataagataatttttaaaatgctaccaattatagttataacaaatcatgaattataagtggcattccaatgtcagaggtgttaaaatgtgacctactcgttaagtcatcttgcaaagtaggtgtaattgtatcattctacctaattaaaatggttttgttaagtagtagtaatagtaataattataatatctggctgggtgcagtggctcacacctgtaatcccagaactttgggaggctgaggtgagaggattgcttgatgccaggagtttgagaccagcctgggcaacaaagtgagattcttactctacaaaaatttttaaataaatagctgggcatgctggtgctcatctgtagtcccagctactcaggaggctggggatggagatcatttgacccaggagttccaggtatagttacaccattgcactccagcctgggcaaaagagtgagactttgtctcaaaaaacaaaaatcttacaattattgagttgtcgtaggaactgttctgcatactttacatagcttctcatttaagcatcatgatggtgtcctatgagatagctactattgtcatctttattaatgaggaagttgaggtacagaaaggctaagcaatagttggtaagtgtcaaggcttaaagtaggactcaagccctagttgaaccgaatccaaagactgagctctttctactcaaataggctgctgttttcattaaggcagtgagcaataagagtaagtattgtactttcttcaaaaaatttatttgttttgaaggcagaggaaaaacatgctattcagtttttacattacatgaatgattgtatgttttgagatattgtactacagtttcttaaaaaatcctcttactctcatagaactgctctacacttggcctgtgccagtggccatgtgcaagtggtcactctcctggttaacagaaaatgccagattgatgtctgtgacaaagaaaacagaacgcctttgatacaggtatattagagccaactcttttagcatgacatggatttgatttacatatatagaattaaaataaattgatctcatttacatataactagttggtgaaacctgtggaatgtgtattttgaattcttggaatttacaatctgtttcttggtctaacacggacaggctgtccattgccaggaagaggcttgtgccgttattctgctggaacatggcgccaatccaaaccttaaggatatctacggcaacactgctctccattatgccgtgtatagtgagagcacctcactggcagaaaaactgctttcccatggtgcacatattgaagcactggacaaggtataggtcaatcaactttctttccaaaatatttgttttaacattgacataggtaagggtcaattttttatatttggaagctcaaccattccctgaatgcaaatacaaattaagttattttgaaataacttaattgtctaagattttattttaaatattgatacttttaaagaagcattaaagggcacagctttataaaatgcactttggaaaatatttgtgaatttgttaaaggtaaaaccttttcaactttttttctacacaggcttattctttttttttttttttttcttaattagtgtaaaacaacaaaggaaagaaaatattccccggaaataggctttatcctaaaactcaaacaaaactaaagcaacttacaataaagggacatgttgctgctgctgctaattttctgaaaaactgatgtatcatctttcagtggcaaggcttaagagggaaaaatgggaggggagaaagagagcgatcagaaatatgcaggtcacttggatattagataatgagggaaaatgccaggaagaggtttttttttgtttttaagtttgttttatgtgttgagacaaggtgctgtttagctttgggtctaataatttttggtttgaaaaagaatgagttgcaacttgcctagagatgaattttaggaggactctgaggaaaccagattggcagtgaatatgtggtgacgaagtgagaaacacttcagcagaaggtggaacaaattattaactgacttattgctcatcctggcagaaacagccacttagataagaacctaaagcctcctctcaaatctagaatgtcttagtgggaaggtgggagataaggagcttgtaaatagcaaaatcaagtgggattttgagtttacttgtccctgttctacccatagccaggaaacttaactggagttttaataaatgacactatctcttactcttttctctttttggccacatctccaactgataaaggaattagccatgtgggtgagaggtgagactgaagtgattgtctgctgcactgattctcagaattgtgcattacagtgacctgaggacattttgttaaaaatctacaattgtaggctttcccctgaagattttgatgtaatagacctaataaggcctgaacgtgtttaaaaatgttttcttgaagctgggcacagtggtgtattcctgtagtcccagcttgagcctaagagtttgaatccagcttgagcaacatagtgagactcttgtctctaacaacaataatagccaaaaaaaaaaaaccacaaaaaaacaaaaaaccttcaaggttgggatacactcttgattaaaaaccccagaatagataagtgcaatatataaatttctgtatctcaaaaatgtaagaaatctctagaagagttggcatttgatagttgccacttccttcaaagttctccttttcaattatattagcctgacttatctgtctttctctacatctgtgactgggaagtgaaaggaaatatcattggcaatatctctcagcttacagaataacatgttttgcttcccaccatgaatcattcactaccattcagagagtattcagaaatttgcttatgagtaatctttcaacaggtagaggctgaccctttcatgatttcatgtccctttgtcaccacgcaggtgattatgtgtcaacaaatgttcattacaagtttggctttctcaattaagatagtagcaaatcctaaactattttttttagttgaagttttattatgaactatctcagtatgtttgttaagtttatagaactttagcatacccaaaatgtcagttttaaacactgaaatccatgaagttaataagaatatagataggaattcttttaataatttagttttagcagtcttgtgaaccaattatctatttggttaacaatcttggaaaattatatacaaacatattttaaatgaatacatgttagaaaaattcttgaagcaggtattgtgagtctttttagcaatttttattatatatgagagcctgattttttggtagaacatatgataccagagaaagaaaatattttacatgcaaatacttggattatacacaaccatttagtaacacattaatagcgaatataaaaaaaacaagggctatattctaatgtggtacacagatttgtttgtttgcctctataagttgaatcaacatgtaaaatttagaagactcgtgaagaaatgtggacttcaggcgtatcctaaaaaatcaaatctggtgtcccctgagtttctatcattctttggtctgctgtgcagaagttgcccctttatagaaggcaggtattctccagtttgctactgtgcccaccttagtacttcccttactcaggcaaccttcctttgtccttgtaagtatctgagtttacaactcctatgttatagtatattttgataaaaatttcaaggtttttaagtcagcatgtatttgtttataatatatagtctatagagtatataaatccctcagttatggagttgaattttagagtttagaagtttttaactcttttctttatatataccacaaataattctctgcccataagaatgcctagaagcctttttaggttattcctggttatagttggataatttatgaatattgcagacagtacatccttctcctcagtgctcttccttaaggatgcaagtgacttattggcttgtattatgccagaaataatccatgtggatcagtatgagaacttctattgataagccattatgtttttatttctgatttatattttgtctaaaataaaaaataattttaagtagccatttaagtggaagccagtaaaaatggatttaaaaagtagagctgcactagggtcccgggattaccattataattgagaatagtatttcttactgagttttggtttttaaaatatttgttcttaagttttttaaacctatctctcttacacagaatatactgagctttctaacagtaaagataaaaatctcttctcttgtattaggggaaaaacccatggactatttaataataaggaaaataaatgcatttgaagccaatctctcttaattcaaagctcatttccatggtgacccatttggagcaggagtgcctgacattggcatctgggatcctgacaccattcataaaagtgaatcaagcaagtttgtaccacccagagggaactgccacctgtattgggaagctctggcaactgtatctctgaaactcttaattcctcaaatgttaatgtttgccacaaatagtattgtgaaaggggattaggtgaaattaaagagatttcttgattattggacataaaatacagttttgtaatacttctcaaatacagatggtcatggagtctttctcttgcggtataatacttctgataaagcaaatattctttggaatatagtttaagagacactgctttagagatagtaatttagatcattaattaatgtaaaaaacttaaaatatttgctactgtgtcttagggttttaggcccttgcctcaagaagctcttggtttcagtgggaaacaatgaaatgactacaatgtaccatgataagtgctgtgatcaaagcaaggattcttgggactagtaaatgtttaaagtgagttttggcaatgaccacagttaatccagggagacagaggagggttgtttgcaaggcaaagcacagcacatcagaaagcacagaggagtgagaatgaagggactgcttttcatttacttcctttctatattgtatgttgaagttcaaagcatcctggagaagattttcagttcagttgagaaatatgtaattttgtgaattattaattttttctgctgttttataggacaataataccccacttttatttgctataatttgcaagaaagagaaaatggtggaatttttattgaaaaggaaagcaagttcacatgccgttgataggctgagacggtacagtagttctttttttaaaaataaaacctgagtattctagagtggtcactcaagtcagaaatattaataagaagattaacataattattggcatataatgaaaaatatcaccatgaataatcaggtagacaagcaaatatttggactgagtaacataaagaatagtatatagtaggattcatcttctcttataatatacagagtttggtatttataatcagatgtttttcgtactgtaatcttttattagctaaagggttttgtattagttttattaattttttttttttttgagatggagtcttgctctgttgccaggctggagtgcagtggtgtgatctcagctcactgcattctccacctcccaggttcaagcgattctcctgcctcggcctcccaagtagctgggactacaggtgcacgccaccatgcccagctaatttttgtatttttagtagagatgggatttcaccatgttggccaggatggtcttgatctcttgacctcgtgatctgctctccttggcttcccaaagtgctgggattacaggcatgagacactgcacctgacaagttttattcattttcaaagtgtggacttttagtttatgactactagcattgtcattattattattgttgttgttgttgttttcagcctgcagataactcttatctgacccctagctgatttgactaggaaagcaatggggaaatcttcatctaaatctttgcctactttagataagtgacctcagcacagtttcttggccatcaaaggactataagttagcaacttgtattatgtcttaccccagtgggacaagaggcttccctgttgtccctttcttttagccttggtgacaatttacaaagatgaacacttgagcaccctagatgcttatagacccaagctagtacatgcaaatagttattacatctatactgacaggcggatattaaactggtaaagtgtatcaaactagctttttaaaaaagtctttattaaagttcttgagtggagttatttctttgttgttttaggtcagctctcatgcttgctgtatactatgactcaccaggtattgtcaatatccttcttaagcaaaatattgatgtcttcgctcaagacatgtgtggacgagatgcagaagattatgctatttctcatcatttgacaaagtaagtgtttatgttaaaaggccagttaatgctaaattgaagtttaaaataattgcaactactccatcttatgcattaggtgagagttcatagtttggttcagatagtttgaaatagcgaagagttagtctaccttttagccagaaatcaagcagaagtctagattagttagaagtagagtgcgagattttttctggatttttgagacatttatccctagggatctcaatgttattcattttattctaagtataatccccatgcatgggataaaaagagccatgtctttgatttcttttcctttcctttccttttttttttttttttttttttttttgtagagacaaggtctcactctgttgccctggctggtcttgaacttttgaggtcaagtaatccccctgcctcggcctctgaaagtgctagccaccatgcctggcctgacttttctaattagttattgagtcttgtaatgtccagtttaacagaaaatcttgtattgtcccctggggctctctcctgtgtcttccttctttgaattttccaagaagctaaggggtttcctaagtccaaggaaggcaatctttctttacaagtcagaagaaggggaaaaaaggccattctaatcattctgttgtttccatggactcacttgctgtattattgccattataaccggtcctgcaatctgataatgattgacctttgccaccaggatgccttcactgattcagacccctcagttttcatggtgattcatatatagaggtcaaagctacggtgtttattagtttatgtacttgtgctcagtcattgttcccagcaccctgctctggcagctaggcctcctagctttatccacacaaatattgagcaagttgatgctcaccctacactaaaaaccttatttggagcccacgtcttagctagactttgcctaggccttcgtggtatgttatcctttgagagccatgtttgtctttcctttaaccaatattagttgggattgttctcaatagtcagggatgttcaaataatgttgcaggaagagatcagagttccctgtctcttttgctatcagatctgtaccttgaggcttttttatatcctgtgcagcagctttggttagatagcggaatgttccatgttatctttccactgagtagtgggaaccagcttgcagttggcccctcaagtaatgtgtctctataatcatgaaaatctcctgggctacttgcagctcttcctcaagttttcaatatattttaaaattctacctcacaggaagccattcaataaaattctctgaatctgaagtaagtgagttggatttaatagagctaagcctcatccatgactcatgaatatccatgtatcaaacagggctttgtacttatttcaacagcacatattttaaaattggatcaatacagagcagataagcatggctactgcctagggatggcacacaaattcagaaaacattccatattttgcctagtcccaggaaggccatttgactatttgttgagtagctccaaggaagcagtgtgagcaaaaccaaaacaggtgacacgcaatattgaaattgtgattatcgctatgaaactattgatgtatggtgatctctgaaatgggaacagagctgagtaataaggggatgttacatgttgttagtacatgtcttggaaatgagaaaatgtcaacttgtatttccttcatggaactgaaaaacaatcaaagcagggttttgtcttgtctgttagttggagaggaccatggagatccagcagccaagcacagatctgctggctcagagtttgaggaggtagagaaggagtggtagttgtccaagccaggttttgacacctattagttttctgcccttggtgtgattgatgagctcagtgatgagctcactaaatttatatatatagaaatttagtaataagttatgaattaggtaaaatgccctgaattacaagccacaatgaatacaagtaataaccaaaattagcacttaataacattttctgaaaactgcaacatttgagtattagaacttacagaaaaacacacaccgagcattatttgggattccaaaatggtttcagcaataaagttcaagaataaattattccattgctttactatttctctgaacatataaacatgtaatctcattacatcttccaaacaacctagtgaagtaaggtagcagaatccttgttttttagaagaaaccatggagcctaagagaagcaacttgtctgaagacaaaatacctacagagcgaggtattttggttacagagcaaggacttactctgagtgcaggacactttgcatgatatccagctaactagagttcatttactgagctgtgcttcctccatttatgagtacttcactttcttttcttctttaattataagcttaataagcttgtaaggtttacaaatttgaagtgtatgggacattaaaattctgatattaggtctgatattgcttgaaagtgttttggaatttaatatgtttggtgaatattttttatttcattataaaaatggcaattttatttattacttttgtatacatagaattcaacaacaaattttggaacataaaaagaagatacttaaaaaggagaaatcaggtaagacttctgattgtgaatttcttacttgtcttggtggtcctactcttgataaaatacaaagtaagatgtaagattaaggtagtttcagtcaaaaaagaccagtttaaaaatatgtgtaaattgaatgtgtatatatgtatatacatatgtaaattaatttttaaaatttaacttctttagtttgaaattcagatttatttaagaaggtagttgtagctaatttacaatctcaaacattattgtctgaaaacattcatttatttaattatgatccctaaaatcctatataatatttttgcataaataagaaaaaagatttttaagttagtatgttgtatgtttcctctatagtcacattataacaaattggacttgttatacaaatggatcttcgatttcatttttataataaattgtttatatttagtaaacaaataactacagttgacccatgaataatgtgggggtgagggactctgatccctgtgcagttgaaaatctgagtataacttttgattccttcaccttagctactaatagcccacaattgactggaagccttcctgataacataaacagttgatgaacacctattttgtttttgctgcattattatatactgtgttcgcacaataaaataagctagagaaatgaagctgttagaaaggaaatcatcaggagaaacatattgacttttcataaagcataagtagtcctgacaaaggtcttcatgatcttcaggttgattaggctgaggaggaagaggagaggtggatcttgctgtctctctgttgcagaggcagaagaaaatctgcatataagtgaatccctgcagttgaaacccttgctgttcaagggtgaactgtattacatattgatttgtgtcactaagaaagtaactatctttagaaccaggaactcagcaatccctttctggtaccataaataaatggcaataagaactgtagaactgaaccagtgtgcacccatacaaataggagattattttttgaagacagctactgagcacaggagacggaaaagcaattcctttgtgagaagcacaagttatattacatattcgtacacaagcaaaatgattttatctgtcatagtttacatacatacacatacacacgtgcacatgtgcacacacctgtgcacacagacacaaagttaaaagtcctgcttattcttaatgaccaaatccaactgttcacagagagcggtggataacgcatcctactgtttggatgcaattcttttgactttttgacttgttttgtgatgaactgcctttaatgggtttaaatcatgttttcagttttatgagaaatgaagaaaaagattagaagcaagtaaacaggaactctatggtcagtagtagactataatagtatattcaatagtcatatgtttttctccagttacacaatttacttgaatgatgcacaattaatcaattattattatcataggagatggggtctctctatgttgcctaggctagaatacagtgtctattcattggtgcaatcatagctcactgtagccttgaactcctgggctcaagcagtcctcctacttcatcctcctgagtagctgggactacagttttgtgtggttacatctggcctgatacacaattatttatttgtttatttatttttaatacagggtctccctctgttgtcagtactggtgtgcagtggtgtcatcttggctcactgcaacttctgcttgctggccttaaatgatcctttcaccttagcctcccaagtagcttggactacaggcatgcactaccacacttggctaattttctttttaagggatttttgtttgtttgtttgtttaatagatgaggtctcactatattgccgaggccggtctggaacttccgggctcaagtgatcctcctgcctcaacctcccaaaatgctcggatttacaagtgtgagccactgcacctggccttcaaaattattataaaaaggaatgaagcccagttgagttgcagaaaattgaccactttttcattttttttctagaaacattcatattgtagaacatattgtcaatcacccagattctctattttttattcagataaaagaggattgctgctcatttcacattattttctgacattattttttcatttattccttctatggctttattcaattggatagatatagaaatacgagaatctccaagtcaaatatcaaggcaaaaaaagaaaagaaaaacagattaggtaaagttattctgtgaaataaccatctgattacagttacacgtatcatatcaacttaatacaaatcttacacaatgaatttgtgtcaaggtttcccaagaccaccccaggtttggtggttcattagaaggactcacaggactcaacaaatagtcatactcagatctttaattgataacaaggaaggggacaagcaaaattagtagaggaaaaaggtgcatgtggtcaattctggaggaaacaaggcacaagcctccaggagttctgtcctgtggagttcccgggatctgcttaattctcccaggctcacattttgacaacatatgtgcagtgatgtctaccagtaccagagtttcattagagactaagtgcccaagtttttctatggaggttactctccctcacatgtacccaaattccagactcttacaaggaaagcagctgtttagagtaaatacactgtttctataagcactttagacacagtgagccactcttctcagggaatggtggaaaccctcccatttccaatttcctaaacaccagccaagggccagccttgcatgcaggcctttctaaggatggcagcctcttgcctgctatatgaaatcttttctgcacaacacttgtaaccccaacttaatttttggtgttgttttaaaatttcattttaataacataatattataagataaggtaacttggtactaatttctgttgtatgatccatcttaagttgcagtgcttgttacttttttgacttttggtgatgaacagctatttgtatataagttaccatagcaatgttaggtaattataatctgtcctatttatctcattaacctttcagtaaaattgttaaattaaataagcaaaataatttctgagttaacattagaataaaaattgtcttttattttgattacatgaatagtctagttttcatattgtgctaaatccctgtttagaattatgaaataagataaaatattcaattatttttatcaatattttcttacctaagcatgcaattaaatttatttattttatatattttatatagttcaatttgagaagtaatgaccacatgttgttactttggtcttcaatgatctctaatttttagggtcaccgtgtcttgcttaaatatatcatagtaacaggttcagtgaatatctttattttttattttatttacttatttttttgagacggagttttgctcttgttgcccaggctgcagtacaatgacataatcttggctcattgcaacctccacctcccagtttcaaatgattctcctgcctcagcctcctaggtacctggaactacaggcatgcacaatcatgcctggctaattttttgtatttagtagagatggggtttcaccatgttagtcaggctggtctcgaactcctgacctcaggtgatccacctacctcggcctctcaaagtgctgggattacaggcatgagccactgcccccagccatttatttatttatttatttatttatttattgtaattgttctggagatcctgggatgcatagacagtgaatatctttttgttttttgagatggagtctcactctgtctcccaggctgcagtgcagtggtgcgatctcagttaactgcaacctccaccttctaggctcaagcgattctcctgcctcagcctcctgagtagctgaaattacaggtgccagccaccatgcccagctaatttttgtatttttattagagacgaggttttgccatgttggccaggccggtcttgaactcctgacctcaggtgatccacccatctttgcctcccaaagtgctgagatgacaggcatgagccactgagcccagctgaatatctttttttaaatcaataaccttatttcttagagcagttttaggttcacagcaaaattgagaggaaggtacagagatttctcatatatcccatgcctcccacacatgcatagcctcccccattattactattttccaccagagagtggtacatttgttacaactgatgaacttacattgacacattataatcattcaaagttcatagtttacatcaggcttcactcttgatgctgtacgttctgtgaatttggacaagtgtataatgacatgacatgtatctattactgtaatattatcgacagaacagtttcacagccctaaaaattctctgtgctatgcctgttcatctttccctttctccctagtaactcgtggcaaccattgatgtttactctgtcttcatagttttacttttttcagaagagtcacatagttggaataatacagtggatatctttttgaatagttaaaaaattaaagctccatggcagttgaatgtagtcatttaagatgttctttgtccttttgtttttcttttgcttctttatcattgtaaagaatgatatattctgatgacatatgctttacatacttagaaaacatgatttgtatagatatgtgcacataatagaaagggttgaggaaaaggacaccatgctgtaccacacagcacaaactggagcatcttgctctgtgaggtgggtccagatagattctctagcaatggaaggggacaagtgcaaggggttgtactttataaaactggaatcacaaagtctttcatacttaccttcggttggaaataagaccagacagtgaatgctataggtaagtacataggttcctcactgatcctcttcctttgagggatgaggttgacaacagcctgtattatgatgatgtgactcacctacaactagattctgtcatgagggatagcaagagagttttgctttctgtgaggtgaaaaagaatttttttcccctactagggagaagggcaagcactggaacattctggtagtaaaagggcattgatggttttctttctatatatttttcacatcatatagtactgtccagcagcctgccacacctccctggtgtttcttcagcttctctctgaatgtgaggtgtggttcctagcgtataagctcttaaaggagtgatctttccagtggtttttctgtgggaggtaaaatggcaggtgaatttgggccttgctatatgtagggcagagcaaatagctacaactaagtaaaccacccagcaccttccccaaagagtagtagccagagtaatacattgatctcttttgagctcttttccactagcggctggaaagtctttgcaaggattcctgtttctggtcggattcctatgttttgctgacatctggtgttagggtgttttattctaaactgagcagtttgaactgaagagctagagaggctgtgttgtgttataacaaaataagtgcagtagctcccccttaactgtgggagatacattccaagacccccaagtggatgcatgaaaccatgaatagtactgaatcacaaactgtttttccctatacatacatatctatgctaaagtttaatttataaattaaattgaatctgatgttaccagcagataaggtgtgagaattgaattgtgtcatcagcaggaatgattgcttgcttgttggtggggaaaaaccctccacacatttggtcacagaagccttctttgttgatgattgttgctgtggtgtgacagtagagaaaaatgtgtcaagtatgtctttctgcacgtatagtggataaggggtactactgtgtactctgttttaatggcgcctcatattttggtccagaaatcatgctctttgacactggtgactcatcacacctgttctgctaacaataccatttttactcaacctcatagggtttggctaagatgacttgcatactgcagttcacttgtagataccaaattttaataaatttattcttctttgcatctaataaatacaaagggaagagttcttactgcattaattacctaccaatatgtataacgaatgttaattctaataaggtcccaggcatgctcccaaaggaatgctttgtaacaaagcatcagtcttatgctttaaaaaaccaaaccaaaacaaaacaaaaacaacaacaacaaaaaacaggatctaaagcatacatacaagtgtgcacaatttttttatgaaggtagagtcttactatgtttcccaagctggtctcaaacttctgggctcctcaagtgatcctcctgcctcagcctcccaagtagtttggattagagggatgcatcactgtgcattcttatgcttttaatattctgtacatttgttattgatttaaaatgcattttacctttttctttaatagatgttggaagttctgatgaatctgcagtcaggtaggattttatagatttaaaaaattatgttaactaagaaaatatagatggaagaaacgaatatctgttgagtgttgtattctgggctagacatcctaatatgttctatgcgtttatcatctcataaagccatcacaacatctgtgttcctataacctactgtttattaaataaacaactatggattagagctgattaattgcctcatgatcccatagttaacaaagtagctggcctacagtttgaccatcagcctgcctgccttccaaatcctgtctcttgctcctcagcatagattgacagatatctgtgcagcccttggatcaaggtataggtctgaatcagattagtcagattgattaatttgattaatgtctaaattaatgagagtttaaataccttgaactctcatttaagtttatcattagaatgtggttagtccaagagtttgtcctaataaatttgacaatttcagtggtaaccagtatcttatttttaccatcaaaggctctagggcagatcttacttagctttgccataggggtgtaagttttacaaaagcaagtttaggcaagtcttagagacaaattatttgacttcccagtttggttttccatttaggcaagtatttctgcttacttccataatacattttttagtcttgttgctttttccgtgacttttctataatcttgccttcattttttaaaactttcttctctgcttttcttggtatttcttttgttctattattttttcaaactctgctggctatgtattctaagtttttctatagacagaatcaagaggacatagaattacagaattttaaggaatcttggaatgaattaaaataccttctagtatttttacctgtgttgaacattctggtcaaatgattctctagatagagaatgtgaggctcaaagagtttaggatgcttttttttagacataggaattggcagaaatgagatttgaactcatgttaaagcccagtactcttgcttctttttatatcctattggcgtgtgttttaataatacaaacgggagtgagtctgtgggtagaatgagaatggaattagctggggaacccaatggaagtagataagaatggaatgagcaggggaagtccaagtttgaagataaacaacactggattggataggagtacagactcttctataagagatcaaaatattggggtttatgacaagtttgataaagataaattataaaaatgaaggacacaagatgttgggaattatctacgaaggcacattaaaatagaaggttcaagggagctctaaaaagtttgctgcttttttttaaatcaaggactgacaaacttgaagatttttactgaaagatgctaaaacattttgagacactgggaggagcgtctgcagcagatagaaatgtggtgtcatctacttccatcctgacttagaaaggggtggcttagagcccctggagtactaaggggctggagattgctgaactacatagatctgtggcccagtacaggtgtctcctcacctctgcctcttttcccgattcactgatgtccttcccatgtccatgtgggctggttcaggggcatgattggctggcaaatcagtcatggagttcagttgggtagttggtagtgtgtctagctgggggcaggtgatggagactccagttagcttgtttttcaggagcagggatatagagagctcctagtcctggtcatttgaggccatcctttcaggaatctgtgctttcatagactgaagatttaaagattggagacttctgtggagccctgcagaagtggaatctggaagtgggagcccataggaagacagatacttagagagtacttagggaaatagaggtacacctaccaggactctgtttttttctgacagtctctctccttgggtgtctgagtgcctatgaaaagttttaagggcttgctagtttatgtggacctgaataaggtaggacctatagggtgaaaataatgggattttataattgttaatatttcaatctttctgggaaaagtattctcaataagaacatacacctttgttatttgacttctgtacatttagctttcatacatttcaaatattgtaggggctttcctgtactgatttagggcaaaggaaagcaataggaccttcctaagtgggttccatgctgaggaatcaagactgccatattgaagtgatgcagattagtcttttatccagagacagatcatggaaaagagacagtggatctttctaccttgttttaggttattagttttcttccagtttaggtaacaaaatttatgtcatccattaattgaattttaagttcagcttcaggacagataatttgtgagggcaaatcattgtcaggctctgccaatttattgactgtcactatttgttataaagctcaaggttagttttcattgaatattttatagatttagacaagtggaggcagaaataggtaactaaaatctatttttagaagaggacatattttaattatatcaagaatcactatttaatatatagattgctgacctttccctagattatggtttccttttttgagggggaagctggatataaactggcagttaaaaaaattgtaaagaaatcaacttgctcattttcgttgtgtgtttttgctctcaagcattttccatgaactgcgtgtggattcattgcctgcatcggatgacaaagacttgaatgttgctactaaggtaaagtggtctcttgtaaaattaattttctcactctgaatgtacttttgcatagtatttacttttcaaatttagcagtggtttacctatcattgttttatggtggtaatggaaagttggtcagagaaaaacatacatatggctagttgattcaaaaaatgtgtttaactttggtaactaacaaagattgataagtactgtgacagggtgggagctgaaaaaaaatgaactggaaaattagtagtgacaggaaaatcacattaggaaatgctttctccaatagaggaaatatgaaatttgcttaaggtttatttggataaatactaatactttgacttttaaatcatacgagtgtgactttcttaatatttatgcctgtataaatcttcagtggatcaaattatttgcagtaatcatgggatcctcctggtgatttttagtggcaagaatattcagcacatagcatatagcttttgttcttggaaacttattattttggtatcatattgtttttacgagagattgtttttctacttatattattggttctgtagtgagacaaaaaaaaaataaaaattgtagaaaaataactgagtgtggtggtgtacacctgtagtccctgctacttgggaatttgaggcaggaagattgcttgaacccaggagtttgagaacagcctgggcaacatcgtatctgatttaaaaatataaattgtggaaatatagaaatttaaatttatgttctcaaaatgtgtattgcaaaggaatttttgtgtggtttatgagttgtccatgaagagtttatataaggcacttcatctaattgaataacatgtattttgctgcaaataaccagttctagaagcagagactcttaataccaatggatggtaagactttatcctcataattttgtcattgtagtttatttaaaatatttacttcaccaggtgtggagactcacctgtaatcccagcagttttggaggccgaggtcggtagatcacctgaggtcaggagttcaagatcagcctggccaacgtggtgaaaccctgtctctaaaaaaaaccaaaaccaaaacaaaacaaaacaaaacaaaagcagaaaaattaaccaggcgtgatggtgcatgcctgtaaccccagctgctcaggaggccaaggtgggagaatcgcttgaacccgggaggcggaggttgcagtgagccaagatcgcaccattgcactccagcctgggtgacagagcaagactacatcttaaaaaataaaatagccactcaaagtcctcatatcatattctgaaattttgaatttcagaaggttttctatttagttgtttaaataatcattggaagctcctgcataccgtaagctactggaggtcagtaaacatatttgtgtgtatcctggagtacctagaatacagtcttccatgtaagaagcattttagttgttgttttttgagatggggtttcactctgtcccccaggctggagggcactggtgagatcttggctcactccaatctccatttcctgggctcaggtgatcctcacacctcagccatccaagtagtttaaacaatagagctatgtcaccatagacctgtgtcaccatgctcagctgagttttgtagagacagggttttgccttgttgcccaggctggtctttaactgttgggctcaagtgttctgcctgcctcagcctctcaaagtgctgggttacaggcataagacattcagccttaatagttgtttaatctgaataaatagacaaatgaatttttatataatggaatgttataagtaatataataaacctaatgtatctaataattaaatattgtatttaaaatattgcttacattgtattttttaatatttaagggtgtataagttttgatatgttatgttgagaaattatgccataattaaaaaggaaataaaatagaaataggtcatcagtagaaaatagggttacaatatattttctagtatcattcaactggaatcttaacattgagattttagattaacatttcttaagctttttattagctctaactcatgttctattaaatatacgttttcaagccatacattactctttattattcttatactgtaagttctagggtacatgtgcacaatgtgtgggtttgttacatgtgtatacacgtgccatgttggtgtgctgcacccattaactcatcatttacattaggtatatctcctaatgctatccctccccccttgtccgccccacgacaggccccagtgtgtgatgttccccatcctgtgtccaagtgttctcattgttcaatttccacctatgagtgagaacatgcagtgtttggttttttgtccttgcgatagtttgctcagaatgatggtttccagcttcatccatgtccctacaaaggacatgaactcatccttttttatggctgcatagtattccatggtgtatatgtgccacattgtcttaatccagtctatcattgatggacatttgggttggttccaagtctttgctattgtaaatagtgccgcaataaacatacgtgtgcatgtgtctttatagcagcatgacttataatcctttgggtatatacccagtaatgggatggctgggtcaaatggtatttctagttctagatccttgaggaatcaccatactgtcttcctcaaaggatgaactagtttacagtcccaccaacagtgtaaaagtactcctatttctccacatcctctccagcacctgtgggttcctgactttttaatgatcgtcattgtaactggtgtgagatggtatctcattgtggttttgatttgcatttctctgatggccagtgatgatgagcattttttcatgtgtctgccatacgttactctttagaattctggtgaccaatttttttctgggtggaaagttgattgaaagttctagttttctctctgtgttataataatgttctttcaggtagtggtcgatgaccatatttagctaattgaatgtcttatagtaataaactatatcacagaagtacttacaaaaaactaattgtagcataaatattaattagtattatcagggatatgaaagagcaaaaggctctgttatagatctatttccccatgtactttattgtacttcatgttgtctcttttctttcttggcttaagctcatatttcattgaccaattaggcttgttttttgtttgtatctctcttcattctcatattttaaattgaaatttttggggagtcagggtcttgctctgttgcccatgctgcagtgtagtggcatgatcttggctcactgcagtatccacctctcaggctcaagtgatcctcccacatcagcttcccaagcagctgggactacaggcgcacaccatcatgcctgactccttttggtattttttgagtagagatgtgttctcattatgttgcccaggctggtctcaaactcctgaactcaagcaatccacccaccttggccttgcaaagggctgagattacaggtgtgagccaccatgcctgggcaacattgagattgatttaaagaaattgattagggctgggtgtggtggtgcacactgcttatctcaacactttggggggcagaagtggaagatttacttgagctcaggagtttgagaccagcctgggcagtataatgaggccttgtctctgcaaagataacaataaaaacattagcatggcatgaagggacgcacctgtagttccagctattcaggaagttgaggtgggaagattgcttgaggtcaggagtttgagacaacagtgagccataatcaggcccctgcattctagccctgggttgacagagtgagacccagtttcataaaaagagattgataagaaactcttgatgcaactcattataattttaaaatggaaactaattcttgatattaccttagcagtgtgtccccgagaaagtgtcagagcctttacctggatcttcgcatgaaaaaggaaacagaatagtcaatggacaaggagaaggtgagaaccgtattttatttaaaaagtcttttgatggaggccgggtgcggtggctcacgcctgtaatcccagcactttgggaggccgaggcgggcggatcacgaggtcaggagatccagaccatcctggataacatggtgaaaccccatctctactaaaaatacaaaaaactagccaggtggtgttgtgggcgcctgtagtcccagctactcaggaggctgaggcaggagaatggcttgaacccgggaggcggagcttgcagtgagcggagataccaccactgcattccaccctgggcgacagagcgagactccgtctcagaaaaaacaaaacaaaaaaagtcatttgatggaatgtttctttgaaaatatgagcactaatagagtgtaatagctaaagaaagtgtcctattaactgtataataagtaaaggagaagtgaaatggtgataagttgtgtctctaaccaagggtcagcagttgattctattgggagtaccactaaaggagctgaattgtgagttccattttaagatactctaagacctgaggcaagtcaggagagagggaagaggaaatgaataaagagaaagaaagaatgaggagagcggattgtacatggaataaataaaaaagcatatgcagaggtaagtaagagaggatagtaaaggcaaattgatctgtagaagaaggaagaacatggtgttagaaacaggaaagaagataaagtgagcttccagtaccaaaatgtgtcagagaattacagtaacattttccttctcttgctgtcatcctcgctactggggaggcattaaggattgaggcacctcaccacacagacctgtgttttatctaccatagatgaacatcaccaaagatggtcagccatgtatggctataatttgtttttatagaaaatgttgtaacctcataggatagtatcatataggccaaattaacataattgaatagtgttgggtgatttatggagaagaaattaattcaagaagttattgcctgattaaaagttcattagaaacattatggcttataatgtagtattaaattgagggacataatagggaagaaattgaggctaggccaaaagggcaattaggggaaaccaatatggaagcacatcagtgtagaacagggcattcaaattgtcatgaatgagttgaagagcttctggaaggtgcacattctgattcagcaggtatgggagtctgcatttctcatgagtactcaggtgatttttggtgctggtccttggacacagctctgaatagcaagggaatagccttcctttagagaactctggaaaaagaaccattggagagcaatttaaaaaataacagaatccagggaaagcattaatttccttttatttctgagcatgattctagccacaggggaaggagaatgagatgaaaacagagagattacaggtgtatactactgctgaatacagatgaaaaaagtggtcacaattatccataaaaagcagttaggaagggaagcatcaggatgacagttctaaaaatcactgtttcaaaggaagagggattgtgaaaggacacggagggaggaaagaaagacatttgctggggtcttgggagttgaagccaagtaaacttgagacaactcacttccagttgcttcagcatatgcccagtctcacaaaagaggttattgctgtggagagtactggaggcaggagggagtgctagagttggggtaaaccacagcagctcatttcacttgataactgtcaggcctcagagagagaagtttcactgacatgagtgaataagatgtgattaagttgcatatagatgctttggctaattttttttgatattacaaaattcattctgtgaataccaaaattctctttttcaataaatactgcactgattttgaaatataaatatgtattcatatccagcaagtctgtggtaattcagtgttttcttttttgataaatattttgatatcggaagcttattcgacatggtttattttatgtgatccttgcatgagtggatcaaggagctctaactcaaggccaaatgaggggataggagaaatgtaggtgctgcagtagcccatgtgatcatgggaaaaatgagtagtttgattagctgtcatttcataagtgtgtatactagctgatcaatgtagaacactttctttgatgagaggtgaatcacacattcacctgaactgtcatcccaactgtgtatttcctcagtgacaagacaaggggaatttgtttgtggcatgctggcagcaatgcctctgctgtgttgagttaaaatactctgtacattcaccatcagctttgacgtcgattccctcaggtttgatttgctcctctgtttaatggtcccttttctcctcatcagtccacatgttcacggtgatatccatgcttttctattttaggtataggcatttgaaacataatctcactactgaaatgtaaactgtgcattttaggaatcctatattcctattttcctcattatgtttctgtcatgttgccgtcctaggcaatgaaaagatgccaagaagaaccctcaaaaccttaagtaattatttttatagccaggcatgagaattcagctcgatagtaccactgcatgaatgtttggttggccctgtcatacttacatataattgatgacatatcccctttgctttgtagggcctcctgcaaaacatccttccttgaaggtaattaattatgtatatttttgaatcactaactccatgttgtataaaatatatatgatttatgaatcattttcttttaaaacccattcagcctagcactgaagtagaagatcctgctgtgaaaggagcagtacaaagaaagaatgtacagacattgagagcaggtacatttaatggaatactggaaataagtacattcaatgattggaagtactcacattattcttattcctaattctatttgttcaaaattgaatggaaggcattgacataaatgttattgttggtatccatatttgaataaaaataaatttagaagcataaaaaagattttaaaaatgtaacctttaactcagatgtttctcttttaatgttttgaatagcatgaagttttcagtataaaatttttatacctgtcagggattcaaagcagtgaattttgagactctaagatatttccaatgagttaagtgctacttggagttctgaactttacctagaggaaagctttacttattaacatgtcagattctgttttaactttagaggcttgctgctagtgttattacactgatgatctgaagccaatcagatgttctaatgagcaagactgtgtgtgtaggtgtatatatagctgtgtgtatgtgtgtgtttgtggcatctttgactattaaaaatgaggaaagtaatgattcatttataactggtagacacagtcttttaaaatggtgattttgagactttttggtgttaaggtttttaaaacatgattgcatagaggctaccgacatcataagttggttgtttttcatttcaatgcccttttgaaatctttaactatattgtgatgctcagaaataatatgcagaattttttatttgtgtcccaaaatggtatgtgagtggttatacactttacatacctttctgccactttctttggtgtattttgtattatattttccagatatatccacattgatatgattatctctggtttaattcattttacacttttcattgtattcccttataccactttaccacatttagttagactctcctgttgctgataaatgaagaaagaaagaaaaataaaaataatgtcagattaagtgggcttttctttaatcagtttgtatctattaatatttactatatgagagtttaaagttgaaaagttcagaatacaagcatgcaccaccatattttataaatgcccttagaactgtgactcatgagcctttagcctatgaagttaggacaattcatttctctgaagaagtttgttgtgctgttctcagaaaagaaaactgaaaatagcaaatgatattgtcttatttgacctcttggacatctttgaatgaaactgcaactccagggatactcagatcaaaattcagaagtaatgttttgaacaatatagtttgtgaatgtccagtggatcatgagcccttgatgggaaaatgacctttcaagtttcacttttgcattttttgctcttttccttgacttgtcttaaaagcttaaattcaaccgttttatttttacagaaactgggaatataacttttaaaatttatgtctgtcctgtctcacggtgttgtgtactcttcagatcttgtgtgaatatagacttatgtgggaacaattaggtgttttgtttgtttgtttgtgtttttgagacagagtcttgctctgtcaccaaggctgcagtgcagtggctcggtcttgactcattaccacctctgcctctcgggttcaagcaattctcctgcctcaggccctcgagtagctgatactacctgcatgtgctaccataccctgctaaattctctatttttagtagagatggggtttcaccatgttggccaggctgctctcaaactcctgatctcaggtgatctgcctgcctcagcttgccagtatgctgggattacaggcaggagccactgtgccaggtacaaataagatttttaaggctattatattttatacaattctttggtctatgtgaattctgaaggtattcatgcattgagggaagatcatctcagtttaatgaaagcagtttttaatgtatattcattaaaaatttttttgaagtttttgtctctagtacagagaaacacacaatattgtcatgggtatttgaccttaatgtgtttatgcacaaacttagttattcaaatattttcttatccctgaagaatcctaattattaataaaaaaatttctcatggaaaacaacatatataatagagattgttgagtgataaagtaaattgtagtaaataacagaagcttagaacaagttaagtaaacttgtctgagttaatagaaattacaggacttttaagatacattagaccatgagggagtagtgtgtttgtggggtagaggacatcatggtcctgcttcagtgaagaaagaacttttacaccttattacaatttgtattactatttacattctaataaaaactttattttcagatattttagattatgtttctactagttgaaccatcaatagtaagacttttcaaagatttgggaagttgtgagttgatgataaatatctgtatcaccattcgtgatcaaaaatcagcaactacaagactttggacacacgaacttcatagttaaagaaaggattaatcttggagctgtgtttttatcagggaattatactcttcattacctctgtgaatcgcagttattagagtagaaagagagcaaagaagggaaacaaacatagaaaattttattctagattacctcagttggcttcatgctaccatagttctggcttttaaaaagtcattttgtggtcaaatgtactttgtgtttactccctttatgcagcctacaaccaaacaaaatgcttcttagcaaggcatttgtattcttcccttaaggaaagcaacatataaataacaaagagaatgaggagaaagagtaatttcattgaagttggtatttaacataaatttgtgtgcgggtaccatgattatatttagaattttgggcctggaatagaaaaccagctagacgtctacagatttcctactcaaacacaatgtgcctttgttttatttttacatctgtaattttgcaattattaggtacaactctatgcagtgtcactaaaaataccttccaaaaccaaatattaaataatgcctatggttttctgtattataatgttgatttccccaatattaatgggaaccattgagcatttgccttgtggtgtctcctgagctgtattcacacattccatcaccttgtcttaatggataatcatgcactatgagtatgggttttcagaagagctgtatcatttaaagataacacaggagcatcaaatttaattctgctagaatacctggtctattgattaactgcagctaatatggggtctacttcacatacaagttaaattcagtgcccttaatcagtcatatggtcaggtcaacagtaataaattatgcaatattttttcacccctatagttttaatttctctttccccttatgtctagaattaacattttattttacaaaacatgatgataatcttctagagtagtgatgacaaagtataaatccaaagtttcttacctatgcaaatgacttgtttgcttctattttctcatgagcttggtagatccaggaaacagaacttttaaaacaaaatccccatatgtggctgggcgcggtggctcgtgcctgtaatcccagcactttgggaggctgaggcgggcagataacctgaggttgggagtttgagaccagcctgaccaacatggagaaacacatctctactaaaaacacaaaattagctgggcatggtggcacatacctgtaattctagctactcgggaggctgaggcaggagaatcacttgaacctgggaggcagcagttgcggtgagctgagattgcaccactgcacttcagcctgggcagcaagagtgaaactccatctcaacaacaacaacaacaacaacaacaacagcaacagcaacaaccaccacaaaacccaaatgcatttccttggcacagtaaaactgaaacagaaaaagtgtaaagtaaatacaagtaactgaaacagtttatgtatattattttacttctcatttgataaaatttgtaaagtaatgagcagagtgtatttctccagggacccagatatatacatttattcattcaataaaaattcatgcttacaatggccactgatacttatgtcctaaatatttctgaaaacatctcctcaggcctgcatcatctttgcaacactgccttatattttatctttgttcattgatttatatgcctcagaattttatgctcctcacaataattagagttaattatctctaatgcaaatagatctgtgaaccactcctgaatacctatgtccaagcatcttaaagttttatataaggatttcagaaactgatttctgggttgggcatggtggctcgtgtctataatcccagcactttgggacgctgaggcaggtggatcatttgaggtcaggagttcaagaccagcctggccaacaaggtgaaaccccatctctaatagaatacaaaaattagcaggtggtaatggcacatgcctgtaatctcagctacttgggaggctgaggcaggagaattacttgaacctgggaggccgggttgcagtgagccaagatcatgccactgcactccagtctgggagacagagtaagaccttgtcccaaaaaaaagaaaagaaaaggaaactgatttctgcccaaatctccatctgtagccctttccccatctgcctttttctctggaattactgagctgctggtaatggccccctcaccattcctcttttgcagagaaatacatactctcttggaggcttctctccctctcttgttgctgcctggcatgtgctcaccctttcctgccctctgcctcacttaatctggctaaccttactctctaagtctcagctcatgcatgatctttaggaaagccatccctgacagcttttattttccttccttataccccagtgcctaacacttagcaggaactcaataagtaattatttagcaaaattaagactgtttatacaaagatgattcaaaagattgtcctctacagtctaacagcaaaggggatcaacatgtaaagacatgatgtgcagttcaggtggtaaagtgacgctggaaaagttgacaaagtactaaggaactccaatgaagcagacacctgtgtgtgtggagaaagacagctagaatcaaggaagacttcacacagcattctgagcctttttttttctttttctgttgttggagacaagttcttactctattacccagggtggagtgcaatggtgtgatcgagactcactgcaacctcaaactcctgggctcgagggatcttctcacctaagcttcttgagtagctgggactacaagcacatatcaccatacctgtccaattttttgtagagtcaaggttatctatggttcccaggctggtcttaaactcctggccttgagcagttcccccattttggccttccaaagtgctgggattacagatgtgagctattatgcccagcctactttctgagtcttaaaagatgaaaataaatttttcagaatagtaggggaaaacatttgcgatgtaaaaaatggggtgcacactaattaaggtataaacaacaataattttgcaaattattagtaactgccaactcaattagtgtcttgttaaaaagatactgttatgaagtatagtaaagtgttacattgtatattttgactgtatttcaaaattttgttttgtttctaacagttttgttgatttatgttgggtggaacaatttgtgagtgaccctgagatttcatatggcttgaacctggtgatatctaatgtctccccaagtggtttgttgaaattttggatgattagaagtatttcttaaagaactaaatatttcagtaaacattaagcttcattgaaactctcaaaatataaaatacaaagaaatgttattctctatttatttttatatagattatagtctttatctaactgttcttagttcatttgaactaaaccaatgaatttgtcaacagaacaagccttaccagtggcttcagaggaagagcaagaaaggcatgaaagaagtgaaaagaagcaaccacaggtatatgaaaattcaagtttcttgtttaatattgggttttgtttttttgcttcagtaacaaagcatagtccaaatgacatgaccttttagactatacctttagaatccgatagatcataattttatatttaatttttaaaacatcttaaccagttatgaaacttaagatattcttactatctctagtaactattagttattctggtaattcttactatctctagtaactcatagctgtctttacccttggaattgaggcaagacattttcagaattatcttgctcttttattgttataaccttactcataatacagaaggtaacatgaaatattgggtcatattattaaggaatagaaattgtgaacaatttaacaatgatggccactgagttaaactagtgttaaaggagtcatcattgccaatggttcaaatgttgcagttttatattgctggtcaccagtgccgaggttaaagatttattctgttttgtggtcaccatttgacttctgtgtctgtgttcagggagtgagtggggtcataaaagtcaacccagttgcctattaagagaatcctaccttgtggaatgggacctttggtgtcagggtacaaacaataactttattttgacataaatacatagtaaatgttactaaaatttaaaaaatccatccactatcactagtggaacttaaaatatattagaagtggatataagcagataatccatctagatacataacactatcatagtatattatttgaattagaatttaaatttttgcttccctttcttattggtgttcagtttggctcttaataattcagtgtttgcctagtctgtagttaatcttcagaaatatacacgtactgtaggggctcactttttctggtatgctgaggtaaaatctttgtaagagaggaagattttataatactacctatcagctttgaattcatttctggtagattttacacataatgcattaagtttaatccaaacaaatgctaagcgttcagcttgccagttcatatttctgtcctatgttaagccaaggcaaattatttttcactttttagttacaatcccataatttaagagtggcaacacatagattaagtttcacagttaaattttaattattttctagtatttttgtttatacttgattaaagctaattttaaaacatgcactctgacagaaaaggcatctgagaaacaaaacaagcaaatttgttttccattttgcacctgccaaaaaaaaaaaaagtctcaagaaccagaactgggtaagaattgtgataaagggaataatctgtctgtatattcacgactttctttaaaattcattacaaacaagttcaagctgaatattggtgaaagttttgaaaactccagaattactgcttgccctgaggaagagctcctacatagtaactctaaagagggacgaacaaaaaaggagtgccctctaatctgatgaatcaggtccctgattgtgaggaggaagatgcatctggagggtctaactctgtggcattccaggcagcgcctgaacagaggaagcccatgtcaaatgtctttttattccattcatactccaggtccctgaaatacagttaccagtcatcttctaagcttcatttaaatgaaaataaatcagactataaaaatgatagcaaaccagacacatagcttgtttctaacacagatgatgaaaatttttgtaatgatactgaaaccaaaaaattaaggaacccagtaattatgattgaaatgaaagatgattaagagtttgacatgcaaatggcaaaaaatgtaaacccagataccactaattggaaattggacattaggcattggcctcagtctagagatccagaaagtctttttgatttgttgtttacccaccccaaagaaatgaagcatatgattcagatagaaagccacagtatttctgctgctacagatacttataaaaacagaaaaccaatacagcgtttattccagcagccactatatggcaatcccagtgctaacaactacagaagcatgaatcttgaattataaaatgtgagttattctttaccacatagtgagagaacatcaaaaatatagctagaagacttatgggaagatattccaaggtcaccaacatggcacatgaatagatatgtaacaaacctgcatgttgtgcacatgtaccagaacttaaagtataataataattaaaaaaagaatgaggtaggcatgttacaagttgagttcctggctttggagaaaagcaagtccaacttcaaaaagacagaggttcacttgctgcttctttttcctctttatcaattatttgatttagtcaaattttctattcaagaaaatctcatgtgtacagttacagtggggttatctaaatgtgtaattatgtgtcaaagtagattagttctgctatctgaataatggttctggagaatgttctcataatgtttgttcattaatcaacctatgtctcactatcagtcttccaagtggcgtatgagctgggaaactaattaagccacataccatgtgaccttctgaaccagatcaacataaagaaattgctaaagaaacaagctctagattctagattcttttttcttgtattcatttagagataatttacatttatttaatgatagaatgggaatacaatgggagggaagcaatgactgagacaagccacaaaaacacgtctagccttgagagttgcaacgaatattcccagccaaatgagtctgtttaatgtgttttcatgcatgcaagtttatctgcttagctcaaactgtttgaacttacagtcccatcatggttatttccaatatttttgaaaacaaacatatacttacacatattttaaaaaatcaccactctgcaatatttctgttgaatcagaccttacgttatgttgtttaataaagtatggtaagttttggcatgtatgatttttatcatataagaagcataatttcttagccaaaaatttagcctttgactctttagtagaaagttgagttctgtacattgtgttctaaagatagacaaaaatctagagattttcttctttcaaagtaaaagcagatgaggcctttttccaccctctgaggcattaaattgctttgctcaagttagacttttaatatatctaatttgataaatttatctggtaatttatgtaattcagcaatatggaattgtatcatgttatatggtgccatgaaatgctagtgaatgccacctcaagagctctggatgaaacatttaatatgtcttggttggtttgactcccattatcagtagataatggggttaaagtaggtaactgtaccatatgttttccacctataaacttttgtggtaattgaatgtgaaatctgggaagcatctcattttccagaattctgcactagaaactcagcagtttcactctgcttcttttgttgtggcaaacgttggttcccataattcaaagagaacctttacttttttgatatcacaggattcaaaaaaaaaaaaagagagagataaaaggcagtggggaaaagagtagctcagtacagaaaagggaaaacttctttactgttcctgaaggcctacaaggtcacatcttcttaatctggctatttcatgtaaaatccaggtagtaaagacagaagacatatattatgcctgtgtctttttatttctctgtttctgccagccagatagcataaaaatttataccagatagcaaagagtggatgggaataaaagcacaaaatggagaagagccctttttgaaattttggaaaattcttctattccctcaaacagaaatgagcagatttgacaaaaatttcgatgataaaataagagtatcttataattataataattatgtataatgataaaattaaagtaagcacaaaatacttttatcattaaagtggtgatagttaacctgaatcaagtaataaaaatcagggaaaaagttctttttattgaataaaataataacaattattattcatcttttattaaaggtcaaagaaggaaataatacaaacaaaagtgaaaaaatacaactttcagaaaatatatgtgatagtacatcttctgctgctgctggcagattaacccaacaaagaaagattgggaaaacgtatcctcagcaatttcccaagaagctgaaggaagagcatgataggtaagcctatagcagtgtttttttgtttgtttgtttggttttgggttttttttgtttgtttttgtttttttgagatggagtttctctcttgctgcccaagctggagttcaatggtgtgatctcagctcactgcaacctctgcctcctgggttcaagcgattcttctgactcagtctccctagtagctgggattacaggcatgtgccaccatgcccggctaattttttgtatttttagtaaaaataggatttcaccatgttagccaagctcgtctcgaactcctgacttcacgtgttctgcccacctcggcctcccaaagtgctgggtttacaggagcgagccaccgtgcctggctgcctatagcagtatttcacaggagataattgtcattgtgctataaactaattgaaaattggactaatattccttatgattaacaagttttatatttttaccaggggtatttagccctgcctggtattcagaaaaaagcaaattaacataaaataagatatattttgtaaagtcatgctgatatttaaaaagtaattattagtgttggcaaatgtgaggaaaaaggcattctcatacactgttggtataggaaattagtaaattatttctgaagggtaacttagtgctgtgtatcaaaatttcaaatagcctgacatccctttaactcaacaactccacttctggggctagatttcacaggaaaacataactggtgtaaacatacacacacttattaatatataattaacatgcattaattatatattacacataatgaacaataggttaatgaatatataaaatatatgtaataagaaggtgaattgaaagtattaagaaagaaatataaaaagtgtggggaaacagatgttagactttttagcctagttttggatgacagtcatctgcagatatagtttgtgtgagagacatctgaaggtgtcatctcactctgtaaatcatttggagaaacacctgcaatatttcataaagatgaaaatttatttctagtgaacttatacgcttgtcaataaatagtaactttaaaaatttagttgattgtaaatgatcttttctaattagggagtaattatgactgtgtgatttaaaaaggtaattttgaacctgtaactttactgaattatctctggtatccttttttataatatatattagagtgactagtaacaaaaactttagcagaatattctttccttactacttttcaagtatatgcattcatttgaagatgttgaagtgagaaattaaatatctgagaactgcaaaggaaaaataatccagaacatagaaattttattaggataataaacaacatctgcagaggtagataacaggatgaactccttattttttaacaaaatgaattttaagacaaatgtctttatctgcagatgcaccttaaaacaagaaaatgaagaaaaaacaaatgttaatatgctgtacaaaaaaaatagagaagaattagaaaggaaagagaaacaatataagaaagaagttgaagcaaaacaacttgaaccaactgttcagtcactagagatgaaatcaaagactgcaagaaatactccaaatcgggtaaatcaatctttggtaaaaattctatattttaaactttatcttatcactgttacttataatatccacttgatttaatatatattgtttaggtctaaaaccataaatgttatctcatttttaaaaatgaatgatgacacttacaggtacaattattaatatttattataaatcttggcatccacataggatattattttattacaaagagcttttgaaaacaataatatgccataatttatacttagtgataacctattgataaaaattttgttccaggtaaaatttttccttgtactttcccctatttcatattgattactgcacctaatattataaagaggaaacagaaattattgcaatcgcaaataatctcatgatattctaagaagagctctataaattttatcttatttactattggcgttttgaaataaaagttttctttcgtattgatgtatttacaccacagaagtaactgtgatctgttggagaactagaagtagagtcagaagtcctggggaaaatcctgtagcttgcttatatttttaacatttctttttcaaaattatggtaactagatgagttcatcaatgaatgtatataggagtgactagtataatgtctagtttatgatttagtgaatgtaattcttataactgactataaaagtgttaaaagagtcaaactgaaatagaatgttatcagtgaaacagaactgtaataactctgggaaattttatctgtccaaatatgtgtgaacaaaagttcttactatagggtggtgtatgggttaggtatcaaagtgtaaatgcaattttttgatatatcttaatttagtcaaatttgttaatgctttaatttatgcttttgagtttgttgtaattcagggaaaggcttttccaattctgatattcttaaaaattctctggtgtgtgtgtgtgtgtgtttacttttataaattcattgactctaaatacatttctgaactttctggaatttatgctctataaggttcaaagttttgcttcaactttttctccaggtggatatccacttatggtaaactttttagtggtacggatgtgcaggttattctttaacttcagaggtaatcatgatatgttattttattgagtactagctaaaactttcttttgttttatttaggattttcataatcatgaagaaatgaaaggtctgatggatgaaaattgcattttgaaggcagatattgctatactcagacaggaaatatgtacaatgaaaaatgacaacttggaaaaagaaaataaatatcttaaggacattaaaattgttaaagaaacaaatgctgcccttgaaaagtatataaaactcaatgaggaaatgataacagaaacagcattccggtatcaacaagagcttaatgatctcaaggctgagaatacaaggctcaatgccgaactgttgaaggaaaaagaaagcaagaaaagactggaagctgacattgaatcttatcagtctagactggctgctgctataagcaaacacagtgaaagtgtgaaaacagaaagaaacctaaaacttgctttagagagaacacgagatgtttctgtacaagtagaaatgagttctgctatttccaaagtaaaagatgagaatgagtttcttactgaacaactttctgaaacacaaattaaattcaatgccttaaaagataagttccgtaagacaagagatagtctcagaaaaaagtcattggctttagaaactgtacaaaacgacctaagccaaacacagcagcaaacacaggaaatgaaagagatgtatcaaaatgcagaagctaaagtgaataattccactggaaagtggaactgtgtagaagagaggatatgtcacctccaacgtgaaaatgcgtggcttgtacagcaactagatgacgttcatcagaaagaggatcataaagagatagtaactaatatccaaagaggctttattgagagtggaaagaaagacctcgtgctagaagagaaaagtaagaagctaatgaatgaatgtgatcatttaaaagaaagtctctttcagtatgagagagagaaaacagaaggagtagtaagtatcaaggaagataaatattttcaaacttctagaaagaaaatttaaacatttggttctggatacatgttgaacttagttgaatataaaaatctagattaaaagtgtgtttaccatactgtataattccatttacatgaagcatccagaaaagataaatgtatagggacaaaaagtagattcatgtttgcaaggggctggggctggaagctggtagtgactgctaatgggcatgaggaatcttacagtgatggaaatgctctaaagttggattgtagagatggctgcacaactcagtaaatgtactaaaaatcttttaacttaaaacagatacattctatagtatgtaaattatatttcaacaaagctgttttaataaaaaaaggaaaaatgtgtttactatatcggcttagaaacatgcctcatttctaggaaataaaagatagaggtgagagatgatttactttgagaaaagacattgtgtcacctatgaaattttattaggcacagagtcatattttaaggtagatagttctgtattgctgaaatagtaattttaatgtctttatgttgccacatgttaagaccataatgtagttataaatggaaatgtttacacctgaagtgagtattttcaaattaaaatttaattaagtgattttcttcgacacttaattctagattccccagatgaattgaagtgtattgctgtgtcttgtaataccttgctttaactagctttttatgtattttagttggtatagctttgttattattcatattaacaaatctgaaaatatgtcaaattacgtgtttttatgaccatgtaatgttttaaaggcacctacttgttataaaatcataatttaggataaatgtggtaaaacttagcaaaactatatttggtttagttttcccactggtatttatagtttactttgaatatttatattaataattagctcataatttttattgcaaggctcaatgactgtcattggaatataattttgttcagtacaaagatacttgtagctgtctgtgatttacgagttaggcactacatctccattttcagactgaggggtggcaggcttcacatacagtgggaatggagtaattacaggagggagttgtaggagctttgaagtcagagagggaggtagaggcctttttacctagggcctcaaaggccattggaattttacttttattctgagataggaatctgttggaaggatttgaacaggtgattgaatatgttaggaactttgaggctgagttgagcttctgagatgattgaatgttggaatgaatctgttgtgtaagtaagagaataccaatttggcaggaagagaacatattctgcatccctcactgaattcagtaataaataaaaatgtgtacatgtgattaaaagaaggtgaattgatatgtgtggtgataattttcaaagtagatatgttagaattaaacattattaacataatttaataaggcagtttataaaatcagtaacaaatattttatcaggtggttgtgagacaacttcaacaagaagtggctgacagcgtaaaaaaattaacgacgttagagtctccactggaaggtatatcacgttgtcacattaatttggatgagacacaggcctcaaataagaaattatttcaagtgaaaagtcaagtatgtatggaatttaacatgtcaacagttattctgtagctagttgaattatataacgtgttttaggatactaattttggcagaagcttgattttttattttcattataatgaatgatttccattttactatctttataatgtactatttttttatattgtgactttcattataccattttgaaaaaccattgcataccttttctcttacaatatgtacccttggaaaagttgagaattatacatcattcctcatagaaaattgacttttttcctgttaaacagtatttttaagtaatttgtgtattgctctgatgaggcaagccagattaaatcagaggagaatgtttcatggaatgttccagaaaattgtcttatttcttcacttttgtgaatggacacagaatctgtgtctatttgtttcacagattctaggttaacttgtacagaaaggccattatactattctttgaaatgtgcatgttttaggttaatttacaaactatttgaaaagttaggcattttctttatcttttatttaaaatatactgtaaaactgtagaaatatttagatttgatatagcatgtacatcaaaaattaagagttgagaaaattatcttgatcctgcctttggattttaaaaagattcactgagatgtcattcacatatcagacagttcaaccatttaaaatgtacaactcagtgtctattagtatgttcacagcattttcgtcaccctgaaaagtgaccccacatctcctaggcatgactgcagccttcctccatgtccctccacctacccctgttgtaggcaaccaccgtctacttttgtctccatatgtttgcctgttctgcatatttcatatacatagagttatacaatatgtagtcctttgtgactggctttttcacttagcataatgttttcagaattcatgcatgttttagcacacattcgtagtttatttcttcttatagttaaatgatattctattccatggctatactggttttccattcgttcatcagttgatggacctttaggttagtttccactttttagctattatgaaaaatgctgctgtgaacattcacttacaggttattatgtggacacgggtttttatttccctgccattggactttatcctcagagttaattgggcagatttcagcacttgtcttgctcatgctattctttctgccttctcagtttctgttcatctagcctcattcattcagacctggcagacaatttttttgttttcatgaagctttctctgactgttctgtcattgaccttatgtgttagcaatcgttgtctagtctgtgctgaaaaacttagtccttaattttacatggcttttatttttttatggaagataattttctctcattataaatttgcttaatgggggaataatatataatgtgtatgccacctatccttgcatacattgaaaatattttagcttagaagtttgtagcatacaattcaatcatttataccataccaattatttcttctttgagaccttgacacagtaaggttatattctaaatatatttttagcaattaaatatcaaatctaacccaattagtctaacacaggagatgcgttcaatcacgtgtttatgtttttctctctatgaaaaagaatataaattggccttttttcactatgcagccattactgtgtttctggactgctcccagtctgtcagctgaacagttctgggtgcagcttgtctgatgaaggatagcacagcccctcaatctgagtgctcagcagagtgcttgtgaaggcagcaccacagcaacagttgctcagagggaacggattcaggagccttgacttagcaatagagtccagggttttcagctcagtgtctttagcctgtctctgctggtcatgtcagttacgtactattccatccaggaggtgctatttacattgtagtacatacacagtcattgcctaatgagtcatacagagagaaaagtaagttataaattatgtcccccatttgctgcaactctcagtgttaagaatgattcagtgcagctataggagactacttccattggcatgccacctgcgtaaatacacaattttgttaagatatacaataaaattattatgctaatagcaaatattttatgtagctcactatgttccatgtagtcttctaagtgcttcatgttagtccccatttaaacacctggttttggaaggctgaggcaggaggattgcttgagcccaggagtttgagaccagccagagcaatatagtgagactctgtctctaaaaaaaaaaaaaaaaatttttttaaacacttagctgaggcatggtggtgcatgcctgtagtcccagctacattgggaggctgtggtaggagggttgtttgagcttggaatattgaggctgcagtgagcagtgatcaagccactgcactccagcctaggtagcagagggagactctgtctcataaataaatcatgttgtatagattcccatagaagtgagttagacatcaggcatagaattattagccgctttgatgtctgccttgggagtaaaacacataataaggggcagctttaaaccatctcaatcaatagcctctaacttctccagaaggttcttatttcatgaatttctaagcaagggactacctggattaagacatttggtagacaccattttgagatgaagaatcttgaatgggaagaagggagatctctacttactgaagcttcccgatgacatagttgagtgtcccccaaaaggaactttagaacaagatgttcatcatgccatatctctatggaaaaggaaattatttaaaagaaaacaaaggcaaacaattgataatctgattctcatgggaaagttttcattatcaaagaaaaagagggctgggttccatggctcacatctgtaatcccaacactttgggaggctgagaggggtggattacctgaggtcaggagttcaaaaacagcctggccaacccaacatggtgaaaccctgtctctactgaaaatacaaaaattagccaggcgtggtggtgtgcacctgtagtcccagctacttgccaggcagaggcaggagaatcacttgaacccaggaggtagaagttgcagtaagctgagatggcaccactgcactccagcctggatgacacagtgtgactccatctcaaaaaaagaaaaggacaaagtatattggtccaaaaaagaagaaagaatgaaaaaaaggacaaagtatactggttagtatcgtaacagtgagatagtccccctttgagattagaaaataacagtatactcaaagtaacatcaataagaaccaacataaaatagacaagattcactatctacaaaagtaatctgcaccaagtagcaatgtatgagcatgtggtggagaatattgtctataatatgtgtactagaaggaagagacctcaagaaaaaggtcagagctggaaatgtagattagggaatctaggtcaaagttttgagattttaggagtcctgagagaatttaaaaagcgaaatagccaccgggcgtggtggccacacccataatcccagcactttgggaggccaaggcaggcagatcatgaggtcaggagttcaagaccagtctgaccaacatagtgaaaccccgtctctactaagaatacaaaaaattagctgggtgtggtagcacatgcctgtaatcctagctacttgggaggctgaggcaggagaatcgcttgaatccaggaggtggaggttgtggtgagccgagatcatgccactgcactccaacctgggtgacagtgggagactccatctcaaaacaaaaaacaaaaacaaaacaaaaaaccagaaaaggatagggctgaagaacagaggttgctgcatttagaaaggaggcggggtcagaggaatagaaagggatagggctgaagaacagaggtcactgcatttagaaaggaagtggggtcagaggagcagagggagcatttggtcactgctctgctgagtaaagcaggataaagtccttcatgaccgttggacttttttattggaattattaaaaatcagatttcaatataaaaaacacaataattgatgaaaaaagatttctgaatgaaaccatgtgtcatagagtccaatggaaggggagaaacaggataatagaaaagccacaaaaagtagacgaaagttgtttttgtttattgtagaaaaaaataaactttatttaaagagaaatggttaagagaaagggaaaaactgaaacctgtgggtgaatacttagaatgacagtatttagctcagcctgaagacagatgaggatgaaaaatgtaatgggaactagataagagttttctaaaatttgtcttagtaagatgtaatttaagagaacttggaatatcttaaactgttaaaaacaatatttctagagcatctttaaaaactaaaatgtaaatataactactctttttttttttaactaacccttagtattttgtgtgtaaaaaccctcatttgtaacaaacattgttggcagtttaaatttcagaaaagataatgatgaaaatttgaatcatttttagcagttttaagaaaagtgactattattgaaatctgaccttattggcatcaggtttataaaatacactttatacacctgcataaatacgtattactaatccacttatgagaaataatatttttgagataaaagagggtctccagattttacaaaaataattttaaacactttttttaagcctaaaaaagaaaatgaagaattaagaaaactttttgagttaatatcatcactgaagtataatgtgaatcgaataagaaagaaaaatgatgaattagaagaagaggcaactgggtatggttttcatattgtagaacatgttagccatttattaattgatttaactctaattttacttgactaaaacctagatacaaattcattttatgtttgcattttcataattaaatgaattctgttttaaaatgtatttcagaaactcacagcacaactttttagacgtgtgtcatgggggtgggagtcagctgagctgctggggcaaggtgaaattttttttgaatgccaaaatattctttttttttttttttttttttttgagaaaaagtctggctttgtttcccagactggagtacaatggcgcggtcttggctcactgcaacctatgcctccaagcaattttcctgcctcagcctcctgagtagctggcattacaggcatgtgccaccacacccggctaatttttgtatttttattagagacggggttttgccaagttggtcaggctggtctcgaattcctgacctcgtgatctgcccgcttcggcctcccaaagtgacatgagccaccatgcccagccacttattctttaatgattttgaaaacaatgaccacgccttggacatataatgtccagtgcactcttcattatctggtttgaatttttatttctgaagatattttttgctgtctgtggtcattttttcttccttttgtagtatcctctgctgcattcaaattgtttaaagaagacctgtttgtgtcattctttaacatcaaatttatcttgatatgtagcttatattttgtttctgctttttcttttagatataaaacgtggaaatttactcattgtacatgagtacctctgttgtatacatgaagtatacatgttattaaacttgttttacataaataaatttcatatatataaaaatatacgtataacttaaagaaaaagtaaaatgaacattcatgttttgatcacagattttttttaaaacaatggaatctgtctttgaaaccctgaacacagctacttttctatttatttactgagcacttaatttggttttctgattagaatcaacatttttctgtcattgcttttctctacatggttttgtatctctttcattttgttgacattatgtcagcaaagatgtctagatctcttcttcaaagtctttaaatcgtcacacatctctctgcccctttccttttttctaaaactgcctgtatcctttttctcctcaactcagatattaaagatgttttcttctctttttctacattgaatgatctccttgatgctttttgtgtgtacttttttttcttctgatagactgtggtcagtgggtatcaaaatgtacttttgtgtctttttaaatgtatgtgttttacttttttatcttggttactcatctctgggttatggcttatatttagtaatacgttattttacttagcataccaacatggatatcagtagtttatttacaaaaagtgtatggttaggccaggtgtggtggctcacacctgtaatcccagcactttgggaggccaatgtgggtggatcatttgaggtcaagagttcaagaccagtctgaccagtgaaaccccgtctctactaaaaatacaaaatgagccaggcgtggtggtacacacctgtaatcccagccacttgggaggctgagacaggtgaatcacttgagtccaggaggcagaggttgcagtgagctgagaccacaccactgcactttggcctgggcaacaagagtgaaattccatctcaaaacaaaacaaaaaacaaaacaaaaacactgtatggctataatatcactttacctgccatatatgccataaaattgttcttcatattatttatctaagattataatttcatatagaatgctttcaaactatgttcagttgaaactgaaagtaacatagtttatagatttgtttctttgatatgccataacagatgtttaaacaattattaaatatttactcttaaaaatacttgacttactaattctgtacatttctgcagatataagaaactcctggaaatgacaataaatatgttaaatgtatttggaaatgaagactttgattgccatggagacttaaaaacagatcaactgaaaatggatattctgattaagaagctaaaacagaaggtaatttaaaaaaattattttatcttaaggtctagattacatgtgtgagacgtgcaggtttgttatataggtaaacgtgtgtcatgttggtttgctgcacctatcaatccatcacctagatattaagccctgcaggcattagctattgatcttgatgctctccctcctgatcctaataggccccagtgtttgttgttcccctccccgagtccatgtgttctcatcattcagctctcacttctaagtgagaagatgcagtgtttgtttttttcttcctgcattagtttgctgaagatatcagctttgagctcatccatatccctgcaaaaagcatgatctcattcatttttatggctccatagtattccatggtgtatatgtaccacattttctttatcccgtctatcactgatggacatctgggttgattccatggctttactgttgtgaatagtgctgcaatgaacatacaaatgcatgtatctttataatagaataatttatattccaacgtatggtaattttaaatcagttttggtattaaaaatcatgtaattttggaaaatattgataatggaaaaacccaaattctgccaaaatatgttgagaaaatagagggtaaatatatcttttcagactttgaatgcctcaggctcttagttaatcttccccagatctgggaagacctagaaggggagagattgggctacattaatgaggaccatttcaatctcttggccctgcagcagccatttcaaaatatgacaaaaaatatattttggggtaaaatattttgatttccttcagcttcttctctctgtgatgctgcaccagaatcaggttagaaaggaagccacattataagagttaataaaacccatctgatgagatttgatagtttgaagggtgtgattcccagaccctttagatagaaattggggccaaggaaaacaaggtcttattcctcaatataaatctgtcagtgctttaagcagtgaaagatttttcatttaattttacagacttgaaactaatgaaaaggatagcttttaaaatatcaatctctttttctatgaaaaggacatgctgttgattctcttaggccttgaaccctggccagtgatctgaaaccaagcagtacctgtctccagatcactactaccaaaatcactagtaccaaattaatttggggtggggggtaacaggtttattgagaaataatgaacacaccatgcaattcactcatttaaaatatacaatttattaacttcagtattttcagagagttatgcagtcatcattacaatcaattgtagaacattttcatcaccctaaaaacaaaccccacatcatttagctatcttcactagttttcccttcctccctcagccctaggtaaccacccaccttctttgtatagatttgcctataagcctctgaaatgaaaagcaagtggtctactgtgactggcttatttcacttagcataattttccatgctgcatctgtgctgcagcaggtattgatgcagggtttttgctccttagttcagctcaatctggtttcttctctcatgaccaggaaaaattaagcacacagacacattgaagggtgaggaggacagaatttattaagtgaaaggaaagctctcagcaaagaggggcgtcctgcaaacaggtttccacctcacaattgaataccaggagcacaggagctgaagcggccaggctcctgctctgcataaggcgtgaattcctggtgactccaccccatccccccagtgcttgtgggcctcgggtctgctgccggcatgtccaggcaagacaagtccaggttcccttatctgcacataacgtctggtgtaaacacttgtgaggcttgttggggattctccggggacccttccttatctgcctaggcattttgctgtctcctcctaatacagtatcagtacttagtttcttcttattgctgagtgatattccattgtatggatacatcaaacagtttatttatccattcaccaggtgatggacctttgggttctttcccacccaaaggtgatggacattttggttctttccacttttcactcttattaataatgctgctgtaaacatttacgtatgagtttttgtgcttgcatatgtttttgattttctggagtatatactcatgactggaatttctgggtcatatggtaacttcatgcttaaccttttgaggagctgccagtttgttttccaaagtggctgcaccactttacatccccagcagcattggataagggctttaatttctttacatttttcctaacacttattttctcttttttattgaataaaggtttcatcctgtggtgtgaagtgataccacacgtggttttgatttactttttcctaatgactaattacattaagcatctattaatgtgcttattatccatctttatatcttctttgcaaatatatctattcaaaatctttgcccattttttaaattgggttatcttgttatttatgaattgcaaaggttctttatatatcctacatatgtaagtcccttatcagatacatgcttttcaaatactttcttctactcagtatcttaccttttcacttcttgatactgtcttctcaagcacagcagttttcaattttgaagttcattgaatccatttttcctttggagtcatagctaagaaaacactgccaaatgcagtcacaaagatttatgccagggttttcttcgtactttatttattttttgcatgtggatatccagttgtcgcagcaccatttgttgaaaagactattcttttcccattctgttcttttgttaaccttgtataaaatcaattgactgtaaatgtgcaggtttatttgtagattatcaattcttagtttgtttatatctattcttatgccaaggccaaattgaatttaatgagaagattttttcaagcatgttgcatattaccagttgtcttatatcataataaaaattaaatttagtggaatatctttaacttcaccttttgtgcctcaaaggaatctctggccagcttataccttacttactctaagacatgatggcaagtcaggcttacaagacactctttctttttttctctattcaaacctttagtctcttttccattgcctccctctatagttatattttcagtaagttttcatcacaggatctgctgatgtagtctaatatttagtgtattatgttttgctaactcattataattcatagaatcttccatagatgtttaccatccaggaaggagaagtctgagctgccagctttcctcagtggaaatcatgtgaagtcatcatgttgtagttcgcagatcctctttccacctggtagctggttctcttgggtagctctgcatctaatcctttacttggtgcagatcttgcattctcagaaaccacagttccctgtattgacctccttttactgaaacagagatgcacagctctgctttctagctcagtagaggattcttgggatataaagtttaactcattccaagaaaaagtcttaggagtgcagcacttcaaaatcaggtaatgttcaggcaatttatcagagacaaatagtagattagtattttgacttttgaaatttcggagccaagttgtgtgctgtagagaagcattgtggtataatacagagatgggatggtcttaacttctccatacaaacaagcttgaagtaagataaaggagaaattgcatttgatgtcttaacactcaaagcatattgtgcttattttacttctgtgaagactaaaaatcattccataatgttctccttatttcctcattgagaaaaggaaaatgaaaattgaatactagattgattaataaatactcaaagcttattcttttagaattttcattaactgaaatcaggcaaatgtctgattttggttatctaaccaagtatttctagttgtttttcaaatcatacttcttctttctttgcagtcttatttcctaacttgaggggaaattgtaaggagacacccttgccttgttatcagagttcataattgaagggggttttaggaaatgttcctcctcagcagcttatgtctctctcctggttatctactgcttctcaataatgtttgccatcaataaattaatctcaacatttattagatcctactttaaaggagactcttttctctgcataagttatgtttcctgttgtctctttttaaaacttatttttctaacaattatccaggtttttgtggcttaaaagaaaaacatttattttgttcatgaacctatggtttgaaaaaagcttagccaggacaggtcatctctgctcccctcagcttccctaggaatagctgatcagttggggaaatggaatcctctgaagctttgctcacccatgtgtttgatggttgatgctggccattggctggaaccttggttggagcaggcagcatgaatattgacactgacactcccaggctgtctctctggcctgatctcactcacaatctgggggctgagttcaaagggaaagcagtctgagatagggaagccacatgatatcccttttactgcattctattcattagaaggaagtcagtaaggattgcccatattctgtttttttaatgggataaatatagcttctcttttgttttaattgacatgtatatacataattttggccaatagagtgatattttgatacatgtatatagtgtgtaatgatcgagctaactagcacatttactacttcaaccatttttcattttttgaattgtgaacattcaaaatcttctgcctttttaaaaatatacaataaatcatagttaaccatattcaccctacaatgccacagaacaccagaactcattcctcttatctaactgtaattcggtatccattaaccatcctcccctcccctacctctgtgagcttttttgttgttgttaagagacagggccttgctagtccagtctgggctctgggcatctgtagtcacccagactagagacagtggcttgatcatagctcactgcagcctcaaactcttgggctcatgtgatcctctgacctcaccctcctgagcagctaggattatgggcatgcaccattgcacctgtctgatttttgactttgtagagctatctacctatgttgtccagggtgctctggaactttggcctcaagtgattctcctgccttggtctttcaaagtgctaggaaattacaggcaatagccatgttgcccagccctcagtttttctttagctcccacatatgagtgagaatgtgcagtgtttatctttctgtgtctgcacttaacataccatccctcagactgatccacatggccacgaataacaggattgaattcctttatacggtgaatagtattctactgtgtttgtgtgccacagttttttgtccattcatttggttatggacatgcaggttgattccatacatcagctattgtgaatagtgctacaataaacatacgagtacaggtatctttttgatctattgttttcttttctattgcctgaatacccaatagtgggtttgccggatcccttggcagtcccattattagctttttgagaaaacctcatgttgttttctatagtggctgcactaatttaccttcccaccaacagcatgttagagtttactgttctctggaacctcaccagcatatgttatttttttgtcttttcaatgatagcaatttattcaaattgaagcaagattgtatcacattgaagatttgatttttatttccctgaggattagtgatactgagcgtttttaaatttatttattggctatttgtatttcttttttctaaagaaaagtatagttagatattttgcccaattttgaacccagatttttttttactgtcaagttttttgagtttcttgtatattttggatactagtcccttattagatgaatagttgacaatattttctcccattccactggttttctcttcactcagtttgctgggcagaagctctttatcttaatgtaataccatttgtctatcatttggtttttgcctatgcttctgatgtcttacccataaaaatctttgtgcagactaatgtcctcaagcatttttcctccatttacttagagtggtttcataattttaggccttaaatgtcagtcttcaatcaattctgagtttatttcattatgtgctgttacataggaagctagtatcattcttctccatatggatatttagttttcccagtgccattcatttgaagagactgtccttcccccagtgtatgttcttggcacctttgtccaaaatcagttggctgtaaatatgtggatttatttctgggtgtgtattctatggcctttaccccaagaatcattacttcgtaaaatgcaattcaaattagcatgaaacatttgcagtttaaggaaaggcttatggcatcagaatccttatttacaggattcattattttgtgtttttttgagatatggtctttgtctgtcatccaggcagaagtgcggtgatgtggtcataattcactgcagccctgaactctgggtacaagccatccttttgcctcagtctcccaactagctgggtctagaggcatgagccaccatgccaagctaatttaaaaaaaaaattttgtagacatgggggtctcactatgttgctctggctgatctcaaattctggcctcaagtgatcattctggcacaggcttttaaattgctacaattacaggaatgagccaccatgcctagtatagagtgttatattattttcaaagtcttattctgagagccatttattgactttggcctaaataactcaatatgatatctctgaaacttttttttgacatattatggggaatgataatgagggaaggtggttagacactttttactaagagataacttagtgccatctaaggaggaacaaaaatgaattatcagaaaaataaaagtaagatgaagtgcaaaagttctgtggcaaagatgatgatagcaaataatatatttttgtgactcatggtagctttaactttgttcttaaaattctgagtaatttaagggttcacatttgaagaatccactgcattacggataacattttattgcaagtaaatgcatttcaaaatttgctattggttttgtattagattattctcagcctacttcattatcaagctatattattttattcatgcagtttgatgatcttacggcagagaaggaagctttatcttcaaaatgtgtcaatttggctaaagacaatcaagttcttcaacaggagtttttatctatgaaaaaagtacaacagcaatgtgagaaacttgaggaggataaaaagatgttgaaagaagaaatattaaatcttaagacacatatggaaaacaatagggtagaacttagtaaactacaagaatataaattggagctagatgaaaaggcagtgcaggcagtagaaaaattagaagaaatccatttacaggttagttttttaaatcaggtaagtttatctgtaatgtgctttcatttatttcaccgcaaattatattttggatatgtatatattatgtttcctctgcctctcttgtagcaatttgctttgtagagttctagaaaaaaaatggcatctgttttttcttttaaatatttacatttccattattattataacaaaatcaatctttcagagtaatgattctcactgtggagtcatttgatgattaagatcagttggcataagaaacaattgtgatttcaaaattatgtgatacttttgaattggtcttaagctacattgttcattaatcactttttaaaattatgaatggattctattactttttatatgaccagattacattaatactaacataattatgatttcaaatttttataaatcagacaattctgaattcagttattagttttgatcttgctgataaatattttaagcttcagcctcttttactaacatattcacaattgctctttgaatcactgactcaaaatgaaaggcaacaaacatataataattaggttataattgttttaaaagtgtattcttttcctttgttttaggaacaagcacaatatgaaaaacaattagagcagttaaacaaggataatatggcttcactaaataaaaaggaactcacacttaaagatgtggaatgtaaattctcagaaatgaaaactgcttatgaagaggttacaaccgaattagaagaatataaggaagcctttgcagcagcattgaaagctaacaattccatgtcaaaaaaattaacaaagtaagtcaaaacatacactcatagaaaatgaattaagctcattaatttgttttgaaagcataatttttagtgagatggcttcaggagattagtaggaagtgaatgctaatctaataatgtaatttcagaaaataatgttagtaaataatcttacctttaaaatgttagtcaaggatagtttctgtcccatttctttctctctctctctctttttttttttgcttttgtatggcttttttcccctgaaaagtctcatgtagttaacctgatctgttagtttttgtcactaagtactttcgaagctttataattaataatgtgatcttgttataaaattgcttgtcagaattttcctaaatagaaatattaatgagtttaatttattttttggtagatcacaacctaaacccaaagtttcaagtggtactgctactccgggcacaatcatttttgattgtgatctttagtattatcactagagcgtgcctcaagaaagactatttgtgtaacattttcaagatgttacagaaaggcatccttgtgaaatagggaataattatcaaggaatttaaagaagtgtaattcacaaagtggttaaaacataactagaaataccatttgacccagcaatcccattactgggtgtatacccaaaggattataaaccatgctgctataaagacacatgcacacgtatgtttattgcagcactattcacaatagcaaagacttggaagcaacacaaatatccaacaatgatagactggattaaggaaatgtcgcacatatacaccatggaatactatgcagccataacaaataatgagttcatgtcctttgtagggacatggatggagctggaaaccatcattctcagcaaactatcgcaaggacaaaaaaccaaacactgtatgttctcactcataggtgggaattgaacaatgagaacacatggacacaggaaggggggaacatcacacaccggggcctgtcgtggggtggggggatgggggagggataacatttggagatatacctaatgttaaatgatgagttactgggtgcagcacaccaacatggcacaggtatacatatgtaactaacctgcacgttgtgcacatgtaccctaaaacttaaagtataaaaaaaaaaaaacttgttcagcctgaaggggtgtgtggaaggcagaaggaaaaagccccacctccagtgccttggtcacagtgctgggcgctaattgccttcagacatgctttagttctttttgatcaccaaccagccaatctagttctcccccaggagttgttgttctgaattattcctcagtgccaaatgcttaattgttcctagataatgggtgaaatgcacaagggtgaaacctaaaatttgtttgctaaacacaagtattcctaaatttttttgttgttgttcattttagttttcttaacctacattaaggagtacaacatgatgttttgatacaattatttctagtgaagtggttcttataatcaagcaaatcaacatattcttttctcacattgttaccctttaaatatgagtatttctaatggaatcttcagaatctcacaagtagagcccttttagaaggcagcaagtgttacctgtcaagccatatatcactgatagccatttctcttccctgtctactttgtttgtactgcttgttcagtataaatcaccttagaaacacaggtgcttctttagaatgattttaaaattatacttgcttacaacaggtatgctctcacacatcttcagtgtgaaaacactgtttagtggataatttggtttgctctcagggcaagtttttaaaaactgcaagtcattaagaatcattagaggaaaaatgaaatactaagcgtgtgtctttgctatctttacagatcaaataagaaaatagcagtgatcagcatgaagctccttatggagaaagagcagatgaaatattttctcagtgctcttcctacaaggcgagacccagagtcaccttgtgttgaaaatcttactagtataggactcaacagaaaatatattccccaaacacccataagaattcctatttcaagcccacagacttcaaataactgcaagaactcttagactgtggttagttacatgaccatttctcttttgggtttcatttctctaatataattcttgtttttaatttggtgaaatactgaattctgttgacttatgcatgttttgtaaagatcataattagctgtgttaacacagaaaggaaatgggaactttacattttttaattccctggagctctcattttcaagagatacccgtttactaactttattccataaatgtgactaaactgacacatttaaaatgtctttaaaagctgcatttaagttaggttttagaaattgcatattattgcctgataactgatgatatagtttgagatgctttggcttactctctaattgattatagtttagctgtggttcatactgcccccccttttttttaaattgagacagtgtttcactctattgcccaggctggagtgttgtggcaccatcttggctcactgcaacctccacctcccaggttcaagcgattttcctgcctcagcctcccaagtagctgagactacaggcacctgccattacacccagctaatgtttgtatttttagtagagacagggtttcaccatattggccaggctgttctcaaactcctgaccttgtgatctgcctgcctcagcctcccaaagtgctgggataacaggcatgagctaccacgtccagcccatgtcacttttaaagtttctttgcaccagccaggtgtggtggctcatgtctgtaatcccagcacttcgggaggctgaggcaggtgtgtcacaatgtcaggagttcaagaccagcctggccaagatggtgaaagtacaaaaagtagaaaaaaaaaattagccaggtgtggtggagagcacctgtaatcccagctactagggaggctgaggcagagaattgcttgaacccaggaggcggaggttgcagtgagccgagatcgtgccactgaactccagcctgagtgacagggtgagacttcatcttgaatataaaaaatttaaaaaaaagtttatttgcaccatctcaactcttcccacccataatcacaactgaatgattggcatccaaacagtttaccacatatagatgtttattatttagtagaatccaaaataattgcattttatgaattaaacaaaacactaaaatgttcatttccatttttatgttcaaagctttgtgcttggccaggtgccgtggctcacacttacaatcccaacattttgggaggccgaggcaggtggatcacctgaggtcaggagtttgagaccagcctggccaacatgatgaaacccatctctactaaaaatacaaaaattagcaaggcatgttggcaggcatgtgtaatctcagatacttgggaggctgaggcgggagagtcacttgaacccgggagacagaggttgcagtgaaccaagatcataccactgcactatatggagactctgtctcaaaaaaaaaaaaaaaaggtttgtgcttttcttacataagagtacatcctctgactataaaaatcctggaagaaaacctaggaaatactcttctggacttcatacttctcaattaatttatggcaaagtcctcaaaagcaattgcaagaataacaaaaattgacaagtatgatctaattaagctaaagagcgtctgcacagcatgagaaactatcacaggattaaacagacagcgtagagaatggaagaaaatattcacaaactatggatacagcaaacgcctattatccagaatccataagagatctaaacaaatcaacaagcaaaaaataaataacaccattaaaaatgggcaaaggacgtgaacagacacttctcaaaataacacatgtaagtggccaacaaacatattaacaaatgcttaccattgttaatcatcagaaaagtgccaaacaaaacatcagtgagatactatttcacaccagtcagaataacttttgttgaaaagtaaaaagaaaaaaaaaaagatgttggggaagcagtggagaaaagggaacacacaccgtttgtggcaatgtaaattaattcagctactatggagagcagtttggaaattaagaactaaggatgaccgttggatgcagcaatcccattactatactaggggtatacctaaaggacaataaatcattgtaataaaaagatgcttgcacatgtgtgttcattgcagcactattcaaagcagcaaagacatggagtcaatccaggtgcatccaaggcagattgaaaatccaaggtagattggaatgttccatacataccatggaatactatgcagccaagaaaagaacaaaatcatgtcctttgcagcaacatggatacagctggaatccactatcctaagcaaactaacacagaaacagaaaccaaatatctcatgttttcacttatgtgggagctacacattgggtgcacattgtcataaacctgggaacaatagacactgggaaataagaacagggagggacagagtgggccagggttggaaaactacttattgggtcctatgcttactacctgtgtgatgggttccactgtactctaaaccttggcatccctcaatattctcttggaagaagcctacacaggtaccaccttaatttagaatacaaactagaaaaaaacaaacaaaaaaaaaaacaagaaaaatttactattaaaaaagtttactataagtagagaatagaaatttctttttaagataaaatttattgatgtaaaaaaattggattaaacttgtataaagggcagagttttgctaagaatttcaaagcaatgcattcattgaaaagatgactttaattatttaatttttttttttttttgagacaaggtctcactgtatcaccaggctggagtgcagtggtgcaatcttggctcactgcaacctccacctcctggcttcaagcaattctcctgccttagcctcctgagtagctgggactacaagtgtgcaccaccatgcccagctaatttttgtatttttaatagagacagagtttccccatgttggccaggatggtctcgatctcctgacctcatgatctgcctgccttggcctccccaagtgctgggattacaggcatgagtcaccacacctggccattgtttaacctttgtactaataaaacactacctttctaaaatcatgtatatgcagtagaccaatattaactgtatttttgtctgattactctaaacagcattacacaggtgcatcctctgttatctaaacttaaaataagtagaaattttactttatttatgtgattatttttctatttaagcaaacttcaagttatgtctagtcactaaaaatactaaaggtcacattttgtaagtgatacattatttgcatgataatgtttcttgtttaacttaaacattattattatttttacttattttagatggagctggactgtgtagaacaaataactagagaaacaaagagaagtatgttgccaaaatttattaattacatttaggtttattttagaaattaagtgtaaataacaaatggcattccttttcattgtttggttagtagatactatgtcaagtattttttttcttacacacatctaatgcaagatgtgaaaacaaaaactttcacagagaagactgtacttatgcaccataaattcatcatgttccatagcttaaaaaattcccaagaagtctgtgcatctgttttttactggctctacactttcttaagttttgccatcatcatggaactgtcagccagcacactgaaacgattctcagaaaacaaaggcatcaccaagttctcagggttttggtacagattgaaggccaacagacctcagactcattttgaaattcttagctgggcaataacccttcataagcagtcacttgacaggtgacattttaaatctcctatcatatactgtgtcattggcttacatctgttctcaggaaaagttccaaatttttcaccatgaaataaaaacacccacgtcaatgtgattcttgtcaagttactcagccttgttttttgccacttaccgcactctaccctttgctctagcaccaaagtggaggagagtagaactccgcagggctcttcctcacctcaggctctttgccttcgcctcttccctctatctggcaagcttttccttgtccttcaggtatcaacctatgttatctcctccaccagaaagcccatgatattgacataaaagtgggatagatgtcccttttgtgtgttccagtagtgccctgctgtatacctgtcatggtatctatgacactatgtggacattgcctacctgtctgtgtttttaggttatagcatatgactattgggaggtggaccatgccatcttcatcttggaattccagtgctggttctagtaccttagcacgtggctgttgattacatgaatgaagaatgaaaaacctctaatatttaaacacaatagaattaatgccatgtgtaaattatttaatagtaattttgtattgtaaatgtacatagatatttctcattcttactaactctgataaagttctcaactctttagtatttaaactcacatttagttaactgaagtgttttaggtaaagaacataattctttctctttccagttgttgctgtgttgaacacttgctcccgtctacttacttctctataatccactggtaagccacatctaatgaagagaatgtttaaccataaagtcttaaggaaaaattttattatttaaaagattataaaactttattactgggctgtttacacaacattttaattgtttctcataaaatatataacattacaatctttactgaagtaggatgtttttgtatcacatgtgtgatgataatttatagggtaatttaaatgatgttttttagcctccttaagttttaagtggatcttgcaaatgaacaccagtattattgagtttgacgtactcaaattgcccaaatgccagctgtttaaacagccaaagaacgaagtcatcattgatactttagtaaaggtcatcgaaggcttctttgcattttacagcttttactacttaggggagttaaggagtacctgccaggcttgtgcatgctaatgtgacaattttctttttgtagttgaaccgtattttgtggggagatactttgaggctctgtaaatatccagttactcccagaacccactagatttagcatttcatggatgacttgtgtttgaacaattattactatgatggttgccagatgattattttcttctcttctttgctgtacctggagaagtaaaaccaataaataactgagaagggaaagctcatgattctggtgctccaattccccaagattaggccagtggtagacatttcaagctgacttcttgtcttttttatttgtcttcgttactctgtcagcacttttttagtttcaggaacaagatgttctaagctaatgttgtattttctctgctccagccatggaatgagtgatttttcttagaagcagaggtggagccactgaggaagcacaggcgagccctccccagcacgtgctcactggtccccaacagaacaaccgctgccgcatccatgaggtaccaagaaactagcaaagggccttctggctgtctgggcacagtcctcatgtggtccctggctcagcctcaagggtcctgcattagtcttcctgtagcctctgtgctgtgtctgtagatcgggactctgtgggaagggccctgggatgcccaacagcacaagatgtctcatctgccaaatgtccctgccttcctcccactctgacactcaggaataggctacatggcatgtccaggcagtgccaggccacctcactatctcctttgagattggcccagagggcttttggggtgagtgtggagctgggcacctggagcctgaggccagctgtctctccctctgtcttggaggaaaagccatgtcccaaaaaaaaccccagggcctgacctctggacacacatacagggagggagggtctgtgggctgaggggggcattgtaatgagactttgagcacgctgctcaggggcctggtcagtggaccatgctcagagatgacctggtcattaggacctagtcagttgggacctggttagtggtggcctcctcagtaaaggcctcctcagtggggacctggtgacctagtcattggaagcccggttcatggggacctggtcactgatggtcttcttagtgaggcctgatgggctggaacataaacaatgaaaaactggtggggcctatgcagtatactaggggcctggtcagtgtggggccttagtggcttggagcctcgtcagtgagggtctggtcagagggggctcggtcagctggggactgatccatggaaaattgtttagtgggggtcaggtgagcagcgacctggtcaactgtggtcttgtcagtgggaacctggtcagtggggaccaggtcagtgggaaattggtcagtgaggtctggcctatgaggcctattaagtgtgagcctggttaggaagacatggtcagtggggacttggtcagtgggaactggtaaatggaggagtggtcattagaggcctcatcagtgggaaactggtcctgggcggctggtcagtaggaacctggccagctggccactgtgtgacctcaggcagggggtttgtctgtggagtctccttgcctccatctgcagggaaggtgagtcagggcaccttggagggtggctggaaagagaaggtgagaagatgtgttgaatccagcaccacttggcagacctacaactttacacatgacctgtgtgccacctagagggggtcccagccctctctgctgtgcctggtgcccctcctctctctgcatccccaggaccaccatgggtggggaaggcagagattggggagcacctgtagaagctctaatgctggccatgagccctcggtgatgacctgggtgcacctgtgagtggagaagctaggcctggccagagaagcaagagaaacacacacacacatatgtgcacacacacacacaggcacacacgcatgcacaaacacactgcatccacacatgtcagttcaggggatagaggacactgactctgggcgctgttgacccatgcaggctcccattgtggtgggttgtgtcaccccacaatgtcactgttgctgagcccccatcgcctctgtgttgtggagcagttagagacacactgtggtgtctgagtggctctgcgtgaaggaccgttttctaggtgagaggcacatctcaacacagctgactgatcagactcaggtgagtgggacctgctctcttctcttgctcctagcttggggacagtcgctatcagttgggtggttttggcctctgagcagctactgagggtaatccctgaacactcaccggatgcctattctgtgctgacagtcatctcgttcatcctcgcagcaattccattctgcatcttttctgatcacccccgtgattacccaggacaaccccatcaggccctctcacccaggcccagtccagctccatgataacaaagacgcaggtccagagacaactgccctgcatggtgcctgcatctgaccccccttggtgggtagtgaccagcacgacatggaagaagccagggcagcatgcagccagctgccctgcagccccagatggctcctaggccttgggaagtcattctcaaaggggaagctggtcattttgaggtccctggagggaagggtgaatgtgtcatcccaacagccctggaagccagcagcatgccatacatcttacccaacctgtgtgacagaggccccctcctggggcacaagtcccatacctaaagggtcctgtcctagttgaacctcatcctgagccctgggaggggaggagcaccatgggcctccctgcagcagccaggattaccacccaggggactcagccttctgtggccctggccagagttagaatttggcccaagacaagacaagctcactcggagcagcttgtcagtacccggggcctgtgcatgccaagtaagtccaagctggctcaaagagcaaccagccacctctgcaagggtgtgccaggagcaggtggaccagccaccaacctcacccactcaaggaaacagggatggccaggttcccacaccctgagtgaccaccacctgacagctgatgaagtggaggcctgaggaaaagcagatggcactggggccctacctccagggcagaataactgatttaccccgattggcagcaagtgaggttggtggctggtccacctgctcctggtacacccttgcagaggtggctggttgctctttgagccaacttggccttgcctggcatgcacaagcctcagttcaacaactgtgctgcaaatggagccacatagaggaaatgagcagcagcctcaggagcagggtttgcgctgcctttggggctccaatccatgcatcagggctcctacagcactgtgggcttcttgggtgccaagaggcagaccacaggccctcttgaggaggattctatgttcaagtgcagaaagggcccaatctggtggatgaaccacatggccagcttctgggtgcaggcacagtgccacatcttccatcacttcctgatgtgccacaccagcactgaagagacagcctggagacagggcaagaggaaggctgagaaggatgagatggtgagtgccagattctccctggctctgagcccacctccagggtgacactcaaactttaggagtgggagagcaagattgacagcttcaaatgcttcaccaagaagatgaacaacagggcactcggctcaacttcacagccaatgagttgacatgcaagcaggtgatggtgacaggctttaagaaggagcatcagaaggctgccagttcttcagcctcagccaggccttggagctggaccagcccatccacttcaccacagatgccttcaacactgtcagtgagctctttgccaatcatcccaggcagaacctggacccagtcatggacctgttagtgctgtctcagggacaccagaccaacatcctgaacatcatccacatacacaagcaagttcttaccaaagtcgcggaggacaggcaacatgtggcagaagggaagatagagatgcagaggctgatgacaccagaatcacaggaacaggaattctttcaccacttcagtggaaattcaccacttccatccaatttgaatgagagacatgaaatcacagatgcagcatttcttgcaacaagagatactattttttcaaaaatcatccaggaattgataatgttgaatgactagatatttgattgtggactgtttccagttcaaggatactttctacacagaataataacactagcaaggagctagtgccagctatccgtggtagcacaaggatggttttgtgctcaactgaaatccagctgaatacagaattgtgtaggaaacagttaatatgttgacagaatagaaacagtagcaaacatgaactaaatcatgccatgaatgcctaaactaccattgggacttttggaagaatgataataccactttactgctctttgaagtatgaatattttagtgtatatgctgtagaccacaaaccctataaagagtcccaaataagttggctggataaagcctgctgtgcatgtctttatactcaaagactgatgatgcaattcgaatatgtgtccccaccaaatctcatatttaattatatttcctaatgtggaaggtggatcctggtataaggcaattgatttatgaaggcaaatttctcatgaatggttcagcaccatccccttgtaccatcctcacaatcatgagtgacttctcgtgagatctggccactgaaaactatgtcacctccctactctgcgtgttttcctcttgccatgtgagacaactcactctttctttgccttgtacaaagattgaaagatttctgaggcctcccagaatcagaagccctgtgcttcctgtccaccctgcagaaccatgagccaattaaacctctttttcaaaatgaatcaaacagaaaatggcaaatgacgattgcagcattgctataaagatacctgaaaatgtggaagcagctttggaactaggtaatgggcagaggttggaagagtttggaagtctcaaaagaagacagatgagaaaatttttggactatcttagagactggttaaatggttgtgataaaaatcctggcacaaacatggatagtgaaggccaggctgaggaggtctcagatagaaataagaagctttctggaaaaggtcttccttttgaatatggaaagcttacacaatgcctgtaccatcattatacgttagaagctgtgagcttgctttttaattcagaggctcataggaaaaagagaccgtagccttgactcagatgagattttggactttgtaagtttgagttaatgctgaaatgagttaagactcattctggcaaggcatgattgtattttgcaatgtgagaaggacatgatattcatgggatcagggacagaataatatggtttgtctctgtgtccgtatcaaaacccatgtggaattatactccctaatgttagaggtggggcctaggtggaaaaagatttagttataaaagggtgcgggtaggttctccacgaatgataaaggaccatcaccttgatgctgtcctcctgatagcgagtgagttctcatgagatctggttgtttaaaaggctgtggaacctctttcctcactctgtcttcctcctactcctgccttaggaggtatctcattgtcttggcttttggtataattaggaggcttcttgattcctcccagaaacggaagacactatgcttccttcacagcttgcaaaaccatgattcaattaaacctctttcatttacaataatagagaaaattagaactgccgagagagctgtgcatgtcttcaaggccttttttccctttgtcttggctattagcacagggcttctttatatgcaaatttctgaagtcttcttgaatttttccccttaaatggggttttgtgttattgctacatagccaacctgctatagagatacctgaaaaagtagaagcaggctcagtagtgggtagcaaacaaagattgggagggtttggagggattagagcatgacagaaagatgagggagagggaggaagtgatttaatcatggatgggcaggggtgggtgtggatggaaaaaggggtgggtagggtgggaatgagtaggctggctgtagggtggtgggagggtcgtgggtagtaggaagggggagtagcgtgctgcagaggcagagcctcatgtaaaaccattactagggcagtgcacctgtggctttgcaggtttgagcccccatggatgctctcatggactggactagtgttcagtgcctgtagcttttccacactgagggtgtaagctgttggtgggtctctaaatctggggtctgtagggtggtagccctgtgtgggggctccaagtccgtattttccttctgcactgccctagtagaggtttcccaagaactctgcgtctgcagcaggctgctgcctggaaacagtgggaggtgggggtgggaggcagatccttcaccaatggttaagcaacatcttcttgatgctgacctagtaacagtgagttcttatgagatctggttatataacaaggtgtggcacctctttcctctctcagtcttgcttctattccagccatatgaaacatctccttgccccttggccttctggtatggttgtgaggctccctgagacgtcccagaagcagaagccactctgcctcctttacagcctgctgaaccatgagccaattaaacctcttttctttatgatcatacagaaaattagtgctatgaagtggagctatgaagtgccttcaaggccctttccccttttcttggcaaccagcactcagcttcttttcatgcaaatatctggagccttcatgaattttgcccctgaaagtggacatttcttcttttaccacacggccaggttgtgataaagatagctgacaatgtagaaccaggttcagaagtgggtaaaagacagaggtcaggagagttgggaaagcttggaagacagcaagatgaggaaaatttgaccactgtagagaattgttaaatacttgcgatcagaaggctgacagaaggataaacactgaagtccagacttaaaaggtctcagatgaagattaggaatttcctgtgaacaggagccatggttacatttgattggccttagcaaagaacgtggctgcacggtgaccctgccctggacatctatgaaactatgaatttgggggtgatgatttaggatgtatctggtggaatgaacatctaggcagcctagcgaggtgtcctgtctgcattgaatagcctgtgttcttatgcgtgacctaagaaatgacttcaagttggaacttctattgaaatgagaagtggagacctaaagtttggaaaatctgcagcctggccaagtggtcaaaaagaaaagctgattttccgggggaaaattcaaggaggcttagagtatctgcataaaaagaagcccagtgcaaatagccaagacaatgggaaagaggcctcgaaggcatttcacagtcctctgcagcagcccttgctgtcacaggcccccatacagggaggcatcattctccaaaccccagattcatagacccacaaacagcttgcaccctcagtatggaaaagctacaggcactcaacaccagccctgtccatgacggcagctacaggggctgaacactgcaaagccataggtgcagatctgcccaaggcctaggaagaccagccctcatacccctgtgccatggatgtgggacagggattcaaaaaggatgattctggagctgtaggattgagtgactggcctgctgggttttggacatttatgtatcctatgaatcccatctgtgttttgtgcttctttccagcaatttttttttctattggttgagaatgcttacccattgcctgtacaatcattgtagcttggaagtagttaagttgttttataattcacagactcatggcagaagggactgtagacttgtctcagataagactttgggctttggatatttgagtaaatgctgtaatgagttaagatttgggggactgtagggaaggcatcattgtattttgcaatgtgagaaagacatgagatttgggggacccgggacagagtaatatgatttggctctgtacctctcccaaaactcatgtggaattttaatggggaatgttaaaggtgggggctgctggaaggtgatttaatcatggtggagagtggaggttggatgggagggatggggagagttggagggtattgagggggtggggagagttgggggggattgtgtttgggtttatgggtaaaaggcaggagtgggggtggatccttcacaaatgggtaaacaccatctccttaatgctgcccttctgagagtgagttctattcatgattttggagctgtgagattgaatgaacagtgtcctgctgggttttggatgtgcattgggcctgtggtcccacttgtgttatttttcttggaaatttcttccctttggattgagaaaacttacccaatacctgtaccatcattgtacctagaaagaaatgaatgcccttttaacttcagggcctcataggcagaagagactgtagcctgatctcagatgagacttttaacttttcacatttgagttagtgtggaaatgagttaaggcttttggaaacttttgaaaagatgtgattgtattttactgtgtgagaaggacatgggatttgggggggtcaaggtcagcataatatgatttggctgtgtgcctctagaaaaactcacatggaattgtaatcccaaatgttggaggtggggcctggtgggagattatttaatcatggatgggaggtgtgggggtggaagaaaaaaggggtgggtagggtggggaacagtatgctggctgtagggtggtcggagggtggtgggtagtaggaagggggagtagcctgctgcagaggtagaggctcatggaaaacctctaccagggcagtgcacctgtggctttgcaggctttagcccccatggctgcccttatgggctgggctggtattgagtgtctatcacttttccaaactgagggtgtgaactgttggtaggtctacgaatctggggtctagaggatggcggcttcctgcagagcgactcaaagcccttgttttccttctgcactgccacagaacaggatttccaagaggctctgcctctgcagcaggcttctgtctggaaacagtagggggtggaggtgtgttggggggtggatccttcaccaatggttaagcaccatcttcttgatgctgacttagtgatagtgagttctcatgagatctggttgtataacaggctgtggcacctctttcctctgtgagtcttgctcctactcctgccgtatgaaacatttcattgctgctttccttctggtatgattgggaggcttcctgagtcttcccagaagcagaagccaccatgctttctttacagcctgaagacccatgagccaatgaatccccttttcattatgaccacacagaaaataagtactgcaaagtggagctatgaaatatcttcaaggacttttccccattgtcttggctgttagcactgggcttctttttaatgcaaatatctgaagccttcttgaagtttcccctggtggagagtggaggttggatgtgtgggaaggggacagttggagggtattgggagggtggggagagttaggggggattgtgtttggggttacaggtgaaaggcaggagtgccaggctgcaacaaagatagctgaaaatgtaaagcggttcagaagtcggtaacaccagaagttggagagtttggagagcttgaaaaaagacaggaagatgagggaaagttgggaccattgtagagacttgttaaatagttttgattagaatgctgacagaaggaaggccagggaaggccaggcttacaaggtctcagatgaaaatgaggaacttactgggaacaggagccatggttacttttgttttgctgtagcaaagaacgtggctgcagggcgaccttgcccttgagatctgtgaaactttgaacttgagggtgatgatttagtgcatatctggtgaaatgaacttctaggcaccatagcacaagagggatcctgtctgcatcaaacagtctgtgctgttatgtgtgaccaaggaaatgacctcaagttggaacttatatttaaatgataagcagaactcaaaagtttgaaacatttgcagcctggccagatggtcaaagagaaaagctgattttcagggggaaaattcatgaagtctccagaaatttgcataaagtggaggccagtgctaatagccaagacaattgtggggaaaaggcttggaggcatttcagagatgtttgcagcagcccttgctgtcacgggccttgggacctaggagagaagaatggtttcctgggccagccccatggccctgctgctgtgtgtagcctcaggacactgctgcctgcatcccagcagccccagctcctgctccgaccttggctgaaagatgtacaggtacagcttgggtcactgcctcagagggtgcaagctataggccttggttgcttctacatagtgttaagccagtgggtgcacggagcactagtctagagacttgggagcctccatatatatttcagaagatgtatgaaaatgcctggtgtccagacagaaggctgccaaaaaagcagagtctcatgggaaacctctacttgggcagtgcagaaggaaaatatgaggttggagcccccacactggaggccaccatcgtgcagaccccagattcatagacccatcaaaagcttcgtaccctccatgggttaaaaactccaggcactcaacaccagcacagcccatgagggcagctgcgggggctgaacactgcaaagccacaggtgcagagctgcccaaggccttgggagcccaccctcatgcccttgtgccctggatgtgggacaaggatttaaaaaggatgactttggagctgtaggtttgaataagtggcctgctgagtttcagaattttgtgggacttgtaagtcctgtttgtgttttgttcttctctctggcaaaaatcttccttttgggtggagattcttactaaatgcctggacaatcgtaccttggaagtggttaacctgctttgtatttcagaggctcaggggcagaagagactgcagctttgtctcagttgagactttgggcttcagacatttgagtaaatgctggaatgagttaagaccttgggggtcttatccaagacgatggggaaaagtcactgaaggcatttcatagcttaacttcacagtactaattttttgtgtgttcataacaaaaaggggtttaattggcttatagttctgcaggctgtaaaaaaagcatagtggcttggggaaatggcaggtaatgcatcatttcattttgcaaagtgagaaggacatgaaatctgggtaggcagggacagaatgataagatttggctgtgtgttacagaaacttatctggaattttaattggaaatcttaaaagtggggccaagttgaaggtgatttaatcatggagggcagtgggtgttggaaggtggggattggggagaatgggtggattttggtggaggtgaggggtgaaaggtagggttggaggcaggatccctcacaaatggttaaacactgtctccttaatgttttcctcacgatggtgagttctcgtgatggttttggagctgtgagattgaatggatactggccttctgggttttggacttgtgttggccctgtcatctcatttgtgttattttcctggcaatctcaaaccctttggattgagaaaacttgcccaatgcctctaccatcatcataccttgaaagaaaagaactcccttttaaattcagggactcataggcaaaagggactgtagccttttctcaggtgagacgttgaactttttacatttgagttaatgttgaaatgacttaagactttcagcaacttttgaaaaggcgtgattgtattttactctgtgagaaggatatgatattcaggggatcagggtcagaataatatggtttagctgtgtatccctacctaaactcatgtggaattgtaatcctgaatgttgcaggtggggcctggtgggaggtgatttattcatggatgggagaggggtggggttggaagtacaaagaggtgggttaggtggggaggagtaggttggctgtagggtggtgtgagggtggcatgttgtgggaggggagtagcctgctgcagaggcagaggctcatgggaaacctctactagggcagtgcacctgtggctttagcccccatggctgctctcatgggctaggctggtgtttagtgtgtgtagcttttccatactgagcgtgcgggctgttggtgcatctatgaatctggggtctggaggatggtggcctcctgcataggggctccaaacccatattttccttctgcgctgccctagtagaggttttccaagaggctctgcctctgtctcaggcttctgcatggagacagtgaggggtggatatggggtggggggcagatccttcaccaatagttaagcatcgtctttgtgatgctgatctcctcatagtgagctctcatgagatcaagttgcataacaggatatggcacctctttcctctcgctgtcgtgcttctgctcctgctatatgaaacacttcattgccgcttggccttctggtatggttgtgaggcttcctgagtcctcctagaagcagaaacaactatgctttctttacagcccgaagaactgtgagtcaattaaacctcttttctttatgtatatacagaaaatcaatgctgcaaggtgaagatatgaaatgccttctaggcctttcccgcaatctcttggctgttagcactgttttttttaatgcaaatattggaggccttcttgatttttcccttgataatggacccttcttcttttaccacattgccaggctgtgacacagatagctgacaatgtagaagccagttctgaattgggtaatggccagaggttagagagtctggaggatggtaacctcttgtgtggggccaccaagcctttttttttgttttttgttttttttctgctttgtcctagtagaggttttcctagtagctctgcctctgcctcaggcttctgcttggaaacagtgggggttgtgggtggtagggggcagatctttcaccaatggctccaccaatggttaagcattcttgatgctgaccttgtgttagagagttctcaggaaatctggttgtataacagggtgtggcacctttttcctctctctgtcttgtttctacttctgccatataaaacatactattggtgcttggtcttctggaatgattgggaggcttcctgagtcctcccagatgcagtagcctctatgatttatttaaagcgtgcagaaccatgagccagttcaacctcttttctttctgattatacagaaaattagtgctgtgaaatggagctatgaaatgccttcaaggccttttccttattttcttggcaatgagcactcagcttcttttccggcaaatatctgaagcctgcctgaatttttctcctgaaacagactttgcttcttttaccacattgccaggctgcaacaaacatagctgaaaatgtagaagcaggttgagaagtgtgtaacggccagaggttggagagtttggaggtgttggaagaagacaggaagatgtggaaaagtttggaccagtgtagagacttgttaaatagttataattaaaaagatgacagaatgatggacagtgatggccaggcttagaaggtctcacatgaaaatgaggagcttgctgggatgaggagccaaggtcacttttgttttcccttagcaaagaacgttactgcacgatgccgttaacctggagatctgtgaaactttgaacttgagagtgatgatttagagtgtatctggtggaatgaacttttaggcagcaaagctcaagaggtgtctggtctgtgccaaacaccctgaggtgtcttatatgtgaccaaagaaatgacctcaaggtgaaacttatatttaaatgagacggagagcttaaaagtttggaaaatttgcaggctggccaagtggtcaaaaagaaaagctgattttccgtgggaaagttcaagaagatttcagaaatgtgcataaaatggaattgagtgctaatagccaagacaaggataaaaaggccttgaaggcacttcagagacttttgcagcaacccttgctgtcacaggcccccaggcctgggagaaaagaatgatttccttatccagtcccatggccctgctgctgtgtccatcctcaggacactgctggctgcatacctgaagctccagctccaaccatggctgacagatacaaaggtacatcttgggtcgctgcttcagagggtgcaagctgcaagccttggtggcttccacatagtgttgagccagcaggtgcaaaaaggccaagactagaggctcagaatccttcatgtagactacagaggatttacagaaaaacctgggtgtccaggtcgaaactattcaaagaggcagagcctcatgggaatcctttactagggcagtatggaaggaacatatagggttggaaccaccacacagggagcaccattctgaaacgtcagattcatagactcactaacatcttgcatcttcattgtggaaaagctacaggtgctcaacactagcccagcccatgagggcagctgcgggggctgaacactgcaaagccacaggtacagagctgcccaaggccttgggagcccagccctcacgcccttgtgtcctagatgtgggacaaggacttaaaaaggatgattttggagctgtaggtttgaataactggcctgctgggttttggaatgtcatgggaacctgtaagtcccgtttgtgttttgttcttctctctggcaaaaaatcttcctttcgggtggaggttcttactcaatgcctggacagtcataccttggaggtaattaacttgctttgtatttcagaggctcaggggcagaagggatggcagtcttgtctcagaagagactttgggctttggacatttcagtaaatgctggaatgagctaagacattgggaaactgtagagtaggcatcattgtattttgcagtgtgagaacaacatgagatatggggggtcagggtcagaataatacgatttgggtctgcatccctaccaaactcatttggaattgtaatggtgaatgttaaacgtggggcctggtgtgaggtgatttattcatggagaagagtgggcgttggaggtaggggtgtggggagaatgggggagattattttgtgggtgggggtaaaaggtaagggtaggggggcagatccttcacaaatgtttaaacactatctccttaatgccgcctgcgtgatagtgagttctcttgatgatatttgcagctgtgggattgagtgaatactgtcccgctgagttttggacttgtgttgggcctgtgggcccatttgtgctatttttatgggaaatttcttccctttggactgagaaagcttacccaatgcccataccatcattgtacctggaaagaaaagaactccattttaaattcagggactcataggcagaagagactgtagccttgtctcaggagagactttgaacttttttacatttggaatgagttaagacttttggagatttttgaaaagtcatgattgcattttgctctgtgataaggacatgagattctgggatatcagggtcagaataatatggtttggctgtgtgtccctatgaatctcatgcggaatcgtaatccctaatgttgaagcgggtgacttaattatggacgggaggttggtggtggtggaaggtaaaagggatgggtaggattgggaggagtgggtcggtagtagagtggtgggagggtgggtggtagtaggaaggaggagcagcctgctgcagagtgagggactcacggaaaaccctctactagggcagtgcacctgtggtttgcagggtttagctcctcagctgttctcatgcgcgggactggtattgagggcctgtagcttttcctcactgagggtgccagctgttggtgggtctgtgaatctggggtctggacggtggtagccccctatgtgggggctccaagtccatattttccttctgcactgccctagtagaggtttcccaagaactctgcatctgcagcaggctgctgcctggaaacagtgggaggtgggtgtgggaggcagtcccttcaccaatggttaggcagcatgtgcttgatgctgtcttcatgatagtgcgttctcatgagatctggttatataacagggtgtggcaccgctttcctctctcagtcttgcttctactcctgccatttgaaatgtctccttgccccttggcattctggtagctatgaagtgccttcaaggccctttccccttttcttggcaaccagcactcagcttcttttcatgcaactatctggagccttcatgaattttccccctgaaagtggacttttcttcttttaccacactaccaggttgtgataaagatagctgacaatgtagaaccaggttcagaagtgggtaaaagacagaggtcaggagagttgggaaagcttggaagacagcaagatgaggaaaatttgaccgctgtggagaactgttaaattcttgcgatcagaaggctgacagaaggataaacactgaagtccagacttaaagggtctcagatgaaaattaggaatttcctgtgaacaggagccatggttacatttgattggccttagcagagaacgtggctgcacggggaccctgccctggacatctatgaaactatgaatttgggggtgatgatttcggatgtacctggtggaatgaacatctaggcagcctagcgaggtgtcctgtctgcattgaatagcctgtgttcttatgcgtgacctaagaaatgacttcaagttggaacttctattgaaatgagaagtggagacctaaagtttggaaaatctgcagcctggccaagtggtcaaaaagaaaagctggttttccgggggaaaattgaagaaggcttagagtatctgcataaaaagaagcccagtgcaaatagccaagacaatgggaaagaggcctcgaaggcatttcatggtcctctgcagcagcccttgctgtcacaggccctagggcctgacagagaagaatggtttcctgggcaagctccatggccccattgctgtgtgcatcctcaggacactgctggctgcatccctgtagttccagctccagccatggctcaaagatgcacaggtacagcttgggttactgcttcagaggtggctccaagccttgattgtttccatatagtgttaagccagcaggtgtacagagtaagagactagaggcttgggagcctctgtgtagactccagaagatgcacagaaaagcctggatgtctaggaaagaagcttttccaagaggcagggcctcctgggaaacctctactaggggagcaaacaagggacatatagggttgaagcccccacacagggaggcatcattctccaaaccccagattcatagacccacaagcagcttgcaccctcagtatggaaaagctacgaggcacacaacaccagctgtgtccatgagggccgctgcaggggctgaaccctgcaaagccacaggtgcagattggcccaagaccttgggagcccagccctcacacccctgtaccatggatgtgggacagggattcaaaaaggatgattctggagctgtaggattgactgactggcctgctgggttttggacattcatgtatcctatgaatcccgtctgtgttttgtgcttctttctagcagtttttttttttttttcttttggctgagaaggcttacccattgcctgtacaatcattataccttggaagtagtgaagttgccttataatccaaagactcatgggcagaagggactgtagacttgtctcagataagacttcgggctttggacacctgagtaaatgctggaatgagttaagatttgggggactgcagggaaggcatcattgtattttgcaatgtgagaaagacatgagatttgggggaccagggacagaataatatgatttggctctgtgcctcccccaaaacttgtggaattttaatggggaatgttaaaggtgggggctggtggaaggtgatttaatcatggtggagagtggatgttggatgggggggatggggagagttggagggtattggagggtggggagagttggggggtttttcgggggatggggagagttgggattgtggtggggttatgggtgaaaggcaggtgtggaggtggatccttcagaaatggttaaacacagtctccttaatgctgtccttctgatagtgagttctcttcataattttggagccgtgagactgaatgaacactgacctgctgggttttggatgtccattgtgcctgtggtcccacttgtgttatttttcttggaaatttcttccgtttggattgagaaaacttacccaatacctgtaccatcattgttccttgaaagaaaggagtgtgcttttaatttcagggactcataggcagaagggccttgtctcagatgagacttttaacttttcacacttgagttaatgcgggaatgagttaaggcttttggaaacttttgaacaggtgtgattgtattttactgtgtgagaaggacatgggatttgggggggtcaaggtcagcataatatgatttggttgtgtgcctctagaaaaactcacttggaattgtaatcccaaatgttggaggtggggcctggtgggagattatttaatcatggatgggaggtgtgggggtggaagaaaaaaggggtgggtagggtggggaacagtatgctggctgtagggtggtcggagggtggtgggtagtaggaagggggagtagcctgctgcagaggcagaggctcatggaaaacctctaccagggcagtgcacctgtggctttgcaggctttagcccccatggctgcccttatgggctgggctggtattgagtgcctatggcttttccatactgagggtgtgaactgttggtaggtctatgaatctggggtctagaggagggcggcctcctgcagagcaactcaaagcccttgttttccttctgcactgccacagaacaggatttccaagaggctctgcctctgcagcaggcttctgtctggaaacagtagggggtggaggtgtgttggggggtggatccttcaccaatggttaagcaccatcttcttgatgctgacttagtgatagtgagttctcatgagatctggttgtataacaggctgtggcacctctttcctctgtgagtcttgctcctgctcctgccgtatgaaacatttcattgctgctttccttctggtatgattgggaggcttcctgagtcttcccagaagcagaagccaccatgctttctttacagcctgaagacccatgagccaatgaatccccttttcattatgaccacacagaaaataagtactgcaaagtggagctatgaaatatcttcaatgacttttccccactgttttggctgttagcactgggcttctttttaacgcaaatatctgaagccttcttgaagtttcccctggtggagactggaggttggatgggggggaggatggggagagttggagggtattgggggggtggggagagttgtgggggattgggattgtgtttggggttacgggtgaaaggcaggagcgccaggctgcaacaaagatagctgaaaatgtaaagcaggttcagaagtgggtaacagccagaagttggagagtttggagagcttgaaaaaagacaggaagatgagggaaagttgggaccattgtagagacttgttaaatagttttgattaaaatgctgacagaaggaaggccagggaaggccaggcttacaaggtctcagatgaaaatgaggaacttaactgggaacaggagccatggttacttttgttttgctgtagcaaagaacgtggctgcagggcgaccttgcccttgagatctgtgaaactttgaacttgagggtgatgatttagtgcatatctggtggaataaacttctaggcaccatagcacaagagggatcctgtctgcatcaaacagcctgcgctctcatgtgtgaccaaggaaatgacctcaagttggaacttatatttaaatgacaagcagagctcaaaagtttggaacatttgcagcctggccaagttgtcaaagagaaaagctgattttcagggggaaaattcatgaagtctccagaaatttgcataaagtggaggccagtgctaatagccaagacaattgtggggaaaagccttggaggcatttcagagatgtttgcagcagcccttgctgtcacaggccctgggacctaggagagaagaatggtttgctgggccagccccgtggccctgctgctgtgtgcagcctcaggacactgctgcctgcatcccagcagccccagctcctgctccgaccttggctgaaagatgcacaggtacagcttgggtcactgcttcagagggtgcaagctataggccttggtggcttctacatagtgttaagccagtgggtgcacggagcactagtctagagacttgggagcctccatataaatatatttcggaagatgtatggaaatgcctggtgtccagacagaaggctgccaaaaaagcagagtctcatgggaaacctctacttgggcagtgcagaaggaaaatatgaggttggagcccccacactggaggccaccatcgtgccaaccccaggttcatagacccatcaaaagcttcgtaccctccatgggttaaaaactccaggcactcaacagcagcacagcccatgagggcagctgcgggggctgaacactgcaaagccacaggtgcagagctgcccaaggccttgggagcccagccctcatgcccttgtgtcctagatgtgggacaaggatttaaaaagaatgattttggagctgtaggtttgaataactggcctgctgggttttggaatgtcatgggaacctgtaagtcccgtttgtgttttgttcttctctctggcaaaaaatcttcctttcgggtggaggttcttactcaatgcctggacagtcataccttggaggtaattaacttgctttgtatttcagaggctcaggggcagaagggatggcagtcttgtctcagaagagactttgggctttggacatttcagtaaatgctggaatgagctaagacattgggaaactgtagagtaggcatcattgtattttgcagtgtgagaacaacatgagatatggggggtcagggtcagaataatacgatttgggtctgcatccctaccaaactcatttggaattgtaatggtgaatgttaaacgtggggcctggtgtgaggtgatttattcatggagaagagtgggcgttggaggtaggggtgtggggagaatgggggagattattttgtgggtgggggtaaaaggtaagggtagggggcagatccttcacaaatgtttaaacactatctccttaatgccgcctgtgtgatagtgagttctcctgatgatatttgcagctgtgggattgagtgaatactgtcccgctgagttttggacttgtgttgggcctgtgggcccatttgtgctatttttatgggaaatttcttccctttggactgagaaagcttacccaatgcccataccatcattgtacctggaaagaaaagaactccattttaaattcagggactcataggcagaagagactgtagccttgtctcaggagagactttgaatttttttacatttggaatgcgttaagacttttggagatttttgaaaagtcatggttgcattttgctctgtgataaggacatgagattctgggatatcagggtcagaataatatggtttggctgtgtgtccctatgaatctcatgcggaatcgtaatccctaatgttgaagcgggtgacttaattatggacgggaggttggtggtggtggaaggtaaaagggatgggtaggattgggaggagtgggtcggtagtagagtggtgggagggtgggtggtagtaggaaggaggagtagcctgctgcagagtgagggactcatggaaaaccctctactagggcagtgcacctgtggtttgcagggtttagctcctcagctgttctcatgcgcgggactggtattgagggcctgtagcttttcctcactgagggtgccagctgttggtgggtctgtgaatctggggtctggacggtggtagccccctatgtgggggctccaagtccatattttccttctgcactgccctagtagaggtttcccaagaactctgcatctgcagcaggctgctgcctggaaacagtgggaggtgggtgtgggaggcatttccttcaccaatggttaggcagcatgtgcttgatgctgtcttcatgatagtgagttttcatgagatctggttgtataatagggcatgacacctttttcctctctcatgcttgctcctgctcctggcatatgagacatctcattgccccttgacattctggtgtgattgggaggcttcctgagtcctctgagatgcagaaactagtatgcctccttacatcctgcagaatcattaacaattaaacttcttttctttttgatcattgagagcatttttaatgcaaagaagatctattaggtgtcttcaaggccttttcccccatgtcttggctatcagtactcagcttcttttcattcaagtctctgaatcctccttgaattttccccctgaaaatggacttgtcttccataccacattgccaggctttgacaaagataggtgataatgcaggaacaggttcagaagagggtagcagactgagttcaggagagtttggagggcttccaagacaagaaattgaggggaaatttggatctttgtaaagaattgttaaatacttgtgatcagaaggctcacaggaaaatagacagtaaagatcagacttagaaggtctcagatgaagatgaggaacttactgggaataggagccaaggttagttttgttttgctgtagcaaagaatgtggctgcacattgaccctgccctggagatatgtgaaactttgaacttgagggtgatgacttagtgagtatctggtggaatgaacttctgggcagcaaagctcaagaggtgtcctgtctgcatgaaacagcccttgcccttttgtgtgactgaggaaatgacctctggatgggtcttacattaaatgagtcacaactcttatattaaatgagaaacagaactcaaaagtctggaaaacttgcagccttgccaagtggtcagaaagaaaagccgattttcagtgggaaaattcaagaaggcttcaggaatttgcacgaaaaggagcccggtgctaatagccaagacaataaggaaaagaccttgaaggcatttcagagacctttgcagcagcccttgctgtcacaggccctggggcctaggagagaagcatcgtttcctgggccagttccatgagccccctctatgtgcagcctcaggacactgctgccggcatccctgcagctccatttccaactccagtcatggctgaaagatgcacaggtagagtttgcatccctgcttcaggggtgcaagttccaagccttggtgtcttccacatagtgttaagccagcggctgcacagagcacaaaactagaggcttgggggcctgtgtctagactccagagtatgtacggaaaaacctgggtgttcaggcagaagcttttccaagaggcagagcctcatggcacacctttaccagggcagtacagaaggagaaaatggggttggagtccctaaatatggagacaccattctccagaccttagattcatagatgcaccaacagctggcacccttagtgtggaaaagccacaggcactcaacacagcccagcccatgagggcagctgtgggggatatatcatgcaaatccacaggtgcagagttgcccaaggccttgggagcccagccatcacatgcctgtgctctagatgtgagatgtagattcagaaaagatgatttggagctgcaggattcaatgactggcctgctgggtttttgacttcatggggtctgtaagtccttggacttttcagtaaatgctggaatgagttaagtcattgggggacagtagagaagtcatcattgtattttgcagtgtgacaaggatacaagatttggggaccaaaggccagaataatatgatttggttctgtgtccctaccaatactcatgtggaatcgtaatggggaatgttaaagttggagcctggtggaaggtgacttaatcatggagaagagtgggggttggaagtaggggtttggggagaatgggggagattattttgtgggtgggggtgaaagatgaggataggggggtggattcttcacaaatggttaatcactatctccttaatgctgtctgcatgatagtgagttctcttgatgattatggagcttaaagattgagtgaatactgtcctgctgggttttggacttgcattaggcctgtggtcccatttgtgttatttttatgggaaatttcttccctttggattgagaaagcttacacaatgcctgtaccatcattgtaccttgaaagaaaagaaatcccttttaaattcagggactcatatgcagaagggacagtagccttgtctcaggtgagactttgaactttttacatttggaatgagttaaggctgttggaacttttgaaaaggcatgattgtattttactctgtgataaggacatgagattctgggatagcagggtcagaataatatggtttggctgtgtgtccctatgaaaattcatgtggaattttaattccaaatgttgaagttggggcctgggggagatgatttaatcatggactggaaggggttggggtggaaggaaaagggttggttagggtggggaggagtaggctggcagtagggtggtgggagggtggtgggtgggaggaagggggagcagcctgctgcagaggcagaggctcatgggaaaccctctactagggcaatgcacctgtggctttgcagggtttagcccctgccgcagctctcatgggctgggctggtgttgagtgcctgtagcttttccacacaaggtgtgagctgttggtgggtctatgaatctggggtctggaggttggtggccatctgtgtgggtgctccaagctcatatttcccttccgcacttccctagtagagttttccaagaggctctgcctctgcctcaggcttctgcctggaaatagtgggagttgggggtagggggcgaatccttcaccagtggttaagcaccatctttgtgatgctgaccttgtgatagtgagttctcatgagatctggttgtataatagggtgtgggacctctctcctctccctgtcttgctcctcctcctgccacatgaatcatctcattgccccttgacattctggtatgactgggaggcttcctgattcctcttagatgtagaagccactatacttccttatagcctgcagaatcatgagccaagtaaacctcttctttatgatcatagagaaaattagtactgcaaagtgggtctattaaatgtcttcaaggccttttccctattgtcttggtagtgagcactcagcttcttttcattcaagtctctgaacccttcttgaattttccccctgaaaatggacttgtcttcccttactacattgtcaggctgcagcaaagatagctgataatgtagaagcaggttcagaagggggtagcagacagagttcagagagtttggagggctttgcagacaagaagttgagggaaagtttggatctttgtaaagaattgttacatacttgtgaccagaaggctcacaggaaaatggtgagtgaaagccagacttagaaggtctcaaatgaaaatgaggaacttactgggaacagaagccaaagtgacttttgttttgccttaacaaagaatgtggctgcacggtgaccctgccctggagatctgtgaaactgaacttgagggtgatgacttactgagtatctggtggaatgaactgggcagcaaatctcaagaggtgtcctgtccccatggaacagcctgtgctcttatgtgtgatggaggaaataacctctggatgggacttacattaaatgagtcccgtctctcagaactcaaatttaggaaaatttggagcctggccaagtggtcaaaaagaaaagctgattttcagggggaaaattgaggaaggcttcagaaacttgcatgaaaaggagcccggtgctaatagacaagataatagggaaaaaggccttgaaggcatttcagagacctttgcagcagcccttgctattgtgggccctggggcctaggagagaagcatggtttccttggccagttccatgagcctcttctatgtgcagcctcagaacactgctgcctgcatccctgcagctcaagctccagccatggctgaaagatgcacaggtacagctcaggtcactgcttcagaggatgcaggctagaaaccttggtaacatcctcatagtgttaagccactggtggacggagtgtgagactagaggcttgggagcatctctatagattttggaagatgtatggaaattcctgggtgtccaggcaaaacatcccaaaaaggcagagccttatatcaaacttctactagggcagtgcagaaggaaaatatggggttggaactcccacactggagaccaccatcatgcagaccccagattcatagaccccccccccaaaacttgtttcctcaatgtggaaaagtcacaggcactcatcaccagcccagcccatgagggcacccttggggcatataccctgcaaagccacaggtgccaagctgcccgaggccttgggagcccagccctcacacccctgtgtcctggatgtgggacagggtttcaaaaagggtgattttggagctgtaggattgaatgactggccttctgggtttggagtttcatggggccagtaagtcctatctgtgttttgtttttttttctggcaaaattcttccttttggctgggaatgcttacccaatgcctgtacaagcattgtaccttggaagtagttaacttgctttatatttcagaggctcatgggcctaagggactgtagccttgtgtcagatgagactttaggctttggacatttgtataaatgctggaatgatataagattttatgggactttagggaaggcatcattgtattttgcaatgtgagaaggacatgagatttggggagtgagggaaagaataataaaattcagctctgtgtccctaccaaaactcatgtggaattgtaattggaatgttaaaggtggggcctggtggaagatgatttaatcacggtgcagagtgggggttggaagatgggggtgtagggaaaatgggggaattatggtgggggtgaggggtgaaaattggggtggggggtcagatccttcacaaatcattaaacactatctccttattgctgtccttgtgacggtgagttcttttcatgattttagaactgtaagattaaatggatactggcctcctgggttttggacttgcattgggcctgtggtcccatttgtgttattttcctgggaaatttctgccctttggattgaaaaagcttacccaatgcctgtaccattattgtaccttgaaagaaagaacattcttttaaattcagggactcataggcaaaaggtactgtagacttgtctcagatgagatgttgaattttttacatttgagttattgttggaatgagttaagacttttggaaaattttgaaaagacatgaatatattttgctctgtgagaaggacaagagactgcagggtatcaggtcagaataatatgatttggctgtgtttctttaccaaaactcatgtgaattgtaatccttaatgttggaggtgggacctggctggaggtgatttaatcatggatgggagggggaccggggatggaaggaaaggggtgggtagggtgaggagtaggttgttagtagggtggtgggtactaggaggggggagtaacctgcttcagaagcagaggctcatggaaagtctctactagggcagggcacctgtggctttgcagggtgtagcccccatggctgctgtcatgggctgggctcgtgtggagtgcctgtagcttttctgttctgagagtgcaagctgttggtgggtctatgaatctgcagtctggaggatggtggcctcctgtatgtgggctccaagcctacattttccttctgcactgccctggtagaggttctccaagaggctctgcctctgcaggaggcttctacgtggaaacagtggggggtggtgtgggtggatccttcaccaatggttaatcttcttgatgctgatctcctgatactgagttctcatgagatctggttgtataacaagtgtggcacctctttcctctctctgtcttcctcctacacctgccatatggaacatctcattgtcgcttggccttctggtatggtaggagacttcctgagtcctcccagaagcagaagccactatgttccctttacagcctgcagaactgtgagccaattaaacctctttttaaaataatactacagaaaatttgtactgtagagtggagctatgaaatgccctcaaggtttttttcctgattttttactattaacatttggcttcttttatatgcaaatatctgaagccttcttgaattttccccctgaaaatggactttttttcttttaccacactgccaggctgtcacaacgatagctgaaagtgtagaagcaagttcagaagcaggttcagaagctgggtaacgaccgcaggctgcacagtttggagggcttggaagaagacagaaagatgaatgaaagttttgactattgtagagacgtgttaaatagttataattaaaagggtgactgaaggatggatagtgaaggccaggcttagaaggtctcagatgaaaatgaacaacttactgggagcagaagccaaggtaacttttcttttgccttagcaaagaacttggctggatggtgcccctgccctggtgacctgtgaaactttgaacttgagggtgatgatttagggtatatctggtgaaatgaacttctaggcagcaaagctcaagaggtatcttgtctgtattgaacagcctgtggtgttctgtgtgaccaaataaatgacctcaagttgaaacttatatttaaatgagaagcagagctttgaagtttgatttacagcctgcccaagaggtcaaaaagaaaagctgatttttagtgggaaaattcaagaaggcttcagaaatgtgcataaaatggagcccagtgctaatagctaagacaatgttaaaaaggccttgaaggcatttcagagacctttgcagcagagcttgctgtcaaaggccctgagttctaggaccaaagaatggtttcctgggtcagtcccatggtcgcgctgctgtgtccatcctcaggacagtgccgcctgcatccctgcagctccagctccagctccagccatggctgaaagatgcacaggtacagcttgggtcactgcttcagagggtgcaagctgcaagccttggtggcttccacatagtgttaagccagcaggtgcacaggcttgggagcctttgtctagactcaagagtatgtaaggaaaaacctcagtgtccagctgggcagaagcttttccaagaggcagagcctcatgggaaacctttactagggcagtgcagaaggaacatacagggttgatgcccccatacagggaggaaccattttccagaccccagattcatagacccaccaactgcttgcaccctcagtgtgggaaagccacaggcactgaccaccagcccagcccacgagggcagctgtggggaaagaccctgcacagccacagaagctgagctgcccaaggccttgggagccccgccatccactcttgtgctctagatgtgggatgtagatcctttcaggaaagatgatttggagctgtaggatggaatgactttcctgctgggtttttgacttgcatggggtctgcaagtcccatctgtgttttgtgcttccctctgacaaatttcttccttttggctgggaatgcttacccaatgtctctacaatcattgtaccttggaagtagttaacttgctttgtatttcagaggctcgagtagaagggatggcagcgttgtctcagatgagactgggctttggacatttcagtaaatgctggaatgagttaagactttgggggactgtagagaaggcatcattgtattttgcagtgtgacaacgatatgagatgtggggggacctgggtgagaataatatgatttggccctgtgtcactaccaatactctcgtgaaattgtaatggggaatgttaaaggtggggcctggtgggagatgatttaatcatggagaagagtgggggttggaggtgggggagtggggagaataggagagattattttgtgggtgggggtgaaaaatgaggggggacggattcttcacaactggtgaaacactatctccttaatactgtctgcgtgatagtgagttctcttgatgattatggagcttaaagattgagtgaatattgtcctgctggggtttggactgacatttttgtcatttttctggggaatttcttccctttggattgagaaaccttacttaatgcttgtactatcattgtatcttgaaagaaaagaaatgccttttgaactcagggactgataggccgaagggactgtagccttgtctcagatgagactttgaattttttatatttggaatgagttaagaattttggaaacttttgaacatgcatgactgtgttttgctgtgtgagaaggacatgaggttctggggtatctgggtcaaataatatggattgactgtgtgtccatataaaactcatatggaattgtaatccttaattttggggcctggtggtaggcgatttaatcttgaatgggagggggttcggggtggtaggaaaaggaggggtagggtggggaggagtaggttgtcagtagggtggtaggaggatggggggtagtaggaagggggagtagccttctgcagaggcagaggctcatggaaaacctctactagggcagtgcacctgtggctttgcaggctttagccccatggctgctctcatgggctgggctggtgttgagtgcctgtagcttttccatactgagggtgtgagctgttggtgggcctatgaatccgggatctggaggatggtggcctcctttttgggggctccaagcccatattttccttctgcactgccatagtggaagtttctcaagaggcttggcctctgcaggaggcttctgcctggaaacagtgggcggtggtgtgggtgcaggatcttcttgatgctgatctcctgatagtgagacctcatgtgatctggttgtctaacagggtgtggtacctctttcctctctctgtcttgctcctacccctgccatatgaaacatctcattgccacttggccttctggtatgattaggaagggcctggtcagtgtgggcctggtcagtgaactagtcagttgggacttggtcagtgaggcctatttactgggggaatggtcagccagggtctgcttagagagggtctcattagagggatcgagtagtgcaggtcttggtgagtggggacctagtggcagacaaatgtttggtgtctggtcagtgcaaacctgggctgcagggcttggtgagtggagacctggtcagctgtggcttagtggtagccttgtcagaatgggctgggtcactggtgacccggtcaaggggtgctattcagtggaggcctggtcacatggcacctagtcagcagggcatgtcctcatcagtgagacccttgtcagtgggaccctggtcatggcagcctggtcaggtcagtggaacctaatcagtgggggcctggtcagagaggacttgatcagtggtggcttttgtagcactggtctatggggtgacctggtcaacgggggtctgagcggtacatgcctgttcagtggtgcctagtcactaggttcctggtcggggcatctggtcaccgcaggcctggttagtagggacctggtcactggcagcctgttccctggagacctggtcagtggggcttcatctgtggggccaggcaatggggtcatgattggtggaatgtggtcagggaggccttgtcagtgaggccctggtcagtgaggccttgtcagtgaggtccttgtcagtggggtcctggacactgtgggcctggcagcgggaatctagttagtggggcctggtgatgggggcctaatcagtgagagtgtggtcagggaggacctgatgtgcgggatctggtcagcagggacctggtcagtggggctgctgagcactgctgggaggtgtcaggggaaatgcatgttatcaggggccctatggacagctgggatggcccagtggtgtccaatggcccagtcaaaagtggacaaagcaggtgtttggatggacctgggagatcttgctcagagattctgaaagaacaaaggtaaaggaagggccagagtggctagagagatggtaacagtctatgggctgcacaggatggaggaagccagggaacaggcagggtgggcagtaggggtgcagggagaggcaggtgcatgctgggaggtcggaccctgtgagggctgtgggggcgtcaggtggggtgggctccaggtgcactctcagtgtgcactgggcaggtctcggtccaggctctctggaccctggtcgggtgatgtggtcactccctgggggactgctgtcaggcctagccacccacccttggcagcactgtcccatctcaggactggactttctcagatcctgcagagggcacagcctccagcccaggaggggcagccccttggtgcagcctaagctctccatgggcctggagcatccctgccagccctgcgctccctctactcccaggtcccgcttttcaagtgtcagccagcagagaggctccgtcctcccttccctatgtgtctcctgggctaaaacttggggcgcattgggacagggatggtgctttcctcaggcccatttagggaggggactggctcccagcctggcacaggtcctcagctctgccttggttgccttagagtgacatggatcagtcagtgccctgaaggtaaatggaagagactgtccctgctgtgtgggaggctggtctagggatggaggacttggcaggtcctcccagtctgtcaggcctggacagcactgtcctgtctcaggactcagaaaatccggtcttgggatgggacggtgctgcccagggtgggtggccagggcttgacagcagtcccccagggagtgaccacatcagccaaccagggtccagggagcctggcctgagacccacccagtgcattgagggtgcacctggagcccaccccacctgatgcccccacagccctcgcagggcctgacctcccagcatgcacctgcctctccctgcaccccagatgtccaccctgccttttccctgatttcctccatcctgtccagcaggatgggctggtcagtgggatagcctctgtgcacattttgtggcaagtaggagtgacacatcattcctgggaggccccgtggttcctgccaaacccaaccccagaattctccctgaggtggttttaccaaacccataacccagaactgctattgtggtttgggggtcagcacccaccagtgccagggcactactgggaggctgggacctgaccaaagcccatggtgtctgtggcctgaggacagggtgtcttggggccatgaggacaggccaccaatggccgttgggtcatagggcctgagccccagtgtttgtccttccctggctccttctggttcagtcccatcagggctctggatcccaagacgcagcatccaaggttccctccaggaatcctggtggctcggcttactttgtcatgtttcatctgatagcaaaaatatcagatcggctgcacagaaaaatggctcaaagtgcttaatgaccagaagaaatctgggagtagcaagaaggtaatgtggagaggggaggacctccatgactggtgtctgcagagccaggggtacagggacccagtgcagtgacctggcaccacctgcctctcagagggtgggtagcacactgtccttacctgggggacagcaggcctggtcaccggcttttctccctgtccctgcaagcatcacattgctggaagagaatctcatgccagagcttggaccatccctagcttgggggttaggggttgtctcttggtgacctaaatgaaaaaataggtccagatcagagttcgtgatgcatagcactcacccactctttgaatcatgggaggggaggcctagtcctaggtaaacctaaactctttgaggaaccacagagcccaaggctggaaacctccagaatcctccagcccctgatcccccccccccccggggacctctgtggcctgtctcaccagagcactcttctgtctgtagaggtctcaggtgctctacaagggagtcccatttcaggtgtggggctgggtatggtcactcctgctggatgtctagaaggtgaaaaccaaggacctaggaaaataccagatacagcctttccaccgtcatccagagcaggacaaacacgccaggtggtgtcaggagcccaggtctccagctggagggaatgtcaaccctgcagtgggagcccatcatgcatcctaggcacagatgctaacgtaggcaccgcaggtaagctgggtttggtaccccttcctggcttcagaaagaagccaaacaaggagctttctgcagaatgaaacctcttttccatccagaagcactgctgactgtttggtggttgctgttagggcagtgagccttttgtccattctgagattaggctggtttctcctcttggccctggcctacagaccataaaggaaaacagcaagaggtccccagcaaacatctacagatggccctggacatcagccacattcagagaaacgtgtcatgttctgggagggctaaggcatcgagtaaggcctatggggctggaggatcacagggcaggtggggcaatccagagctgtgggggcttccatgggaattgggaggtcccaaggcagaggtaggggttccacaggaggagtcacagagccaccaagggctctcctggcccagggagcagtcaacaccatggactgaacacccactgggctaagccctgggccaggctggggcatgtggggccaggaggcagctcagagtgggagacagagagacaagtgtgctcagagggcacccatatctgcatataacgtggtcctgaatttctggctgggaagtgcttccagggtttcatatgtgttatggagatgcttcctctctccaacctcaccgtgcaggaatcccagtgaatatattgccaccatcttggagctcagtgccctcatagtgtaacagcaccagcagatctgcctgtgcacagacttcctgtactacctcactcctgaggggagatgcttctgcagggcctgcgacctggtgcacaactttagacaccatcatcctggagcggcactgcaccctcactagccagggtgttgatgacttcctcaatgccaaggccacgttcaagattttcgacttcagtgatgcgtttgtgctgagcaaggtgggcttctccgggatcttaattcaggaggtagaatgcagcttgagatctagtgtctgatcaaagaacttgaacttgacctggagggctctggggagccatggaaggtgctggataaaggaagggacagtcatatatattttagagatgactgtggaaggctgcctggaaggagtgaacaagagccaggagaccagggagggagtttgtggggcaggtctggagatggcaagggagggatcctgcttggatgaaaggtcttcagggactgtctcaggttacactcaggtgccctcagagctactgtgttcagggttcttgtctccaggatgaaaataaggaggagttgtcagacaaggacatatacatggaggctggcatcttcatgagtgccaatcgtggtcctggtgtggactactgtgggagcaggggtctctccatccagggacatggtggatggaccctacatcactccattctgcccttcctttccctcccattctcctgagggactcaatgcatgggcactgtccaacctctggtgctgaagcagccaagagacccaagcctgccttgctgccacttaggatatgacagcacagccagtggcctctactggatcctggtacccctcagaagacacccagacactgggagtgctgccacctcgtggtgcaagagttctgagggacggcaattctgaagacattgaatggtgggtgctgggcctcatggctgttccccagcccctctcattggctctgctccaggtggagaagggggatgatgtctctgtcagttctgctgttttagcctagaaggaaaagaagcagagcccagaagcagggcctggtacccagcctgcctaacaagggagaatttgtaggctttgtggacagaaagatctgggactccatgtcacccactaacttgctgagacattagtaaaatcagttttcttttctgaactatgtttctgtcatctgtacattgagaggaatttcttttactccacgaggctgcttggagaattagtgacagtgtgtgtagagcatgtgccacccagcaggcatttggtgtcgagaccacacctcctcccccttcattttcagcctaaatttgcattttgttcttaagactttcactcgccttaattttactctttcctctgattcccaccttatcgtctatcccatggagtcactaggatctaagtgggtaacagtcatgtatgcatgtatgtgtatgtacgtatatactttgttggtgttggagtgtggtgtgtgaatgtgtgtgtgtgtgtgtgttggagttactgggtgactgaaactgtacacatcaggctgtggttctgcccattgctggaagcgctgtcaggggtcctgccctcaaccccaggtctgacccttgcagcgcaggcaggacattctggaggaatcatgcccttgggaggatccctgaggagtgactggtgggtattggtggataaatacccctggtcccttgctctgggtatgatgactctgaagcacatgttctgtgctgtctctcagaggtacctggcagggctgagtcctggctgccacagtggaaactttcttgatgaaggtccctttaactgctgcattcctttcctgtctcagttccccactcctccactgatgtttcctgggattagcaccctaaggaagaactggcagtcgaattaatatcctagcgttatctccaaacaaaatttttgtatttgaatctttgcctcaggatctacttccaggaaattcagactaagacacacatttttcttttggctccttgaatccccataggcctgacattttgctgtttttatcaaaaaggaacatgaggatcagagagggaaagtcacttgcccaaagtcacccagctgaacagtggtagagttcaactttgatcatgagatgtctggcccccaggtggaggcttgctcctctcccatgagactccttccttatcagggtcaaatgaatgaatggaggatgttaaaagtggggtctctgatgcctttgccagataaaccccaggctcatggctggcgcctgttttctcattcttacctcattaagagtagtaatgaaaaacatgctcagtgctgaccgtgtgcctgggggtgttgtaggcactccacttactttaattcatttaattttcacaataaccttgtttttacttctagttgttatatgaaaaaactgaggcaaagagcaatacagagagttgcaaaaattcataccgctggtccaggtttgaaccaaacagtctgcacctggagtccttgtttgtaaccatggcaccctgtcttcacacatatctcatcgtggagttccatcttgtgttaggcatggcactgagcagcttcttttaagaacataatttgtagccaggcgcagtggcttatgcctgtaatcccagcactttgggaggccgaggcgggcagatcacgaggtcaggagatccagaccatcctggctaacttggtgaaaccccgtctctaataaaaacacaaaaaattagctgggcatgatgattggcgcctatagtcccagctacttgggaggctgaggcaggagactggcatgaacccgggaggtggaacttgcagtgagccgagatggcgcgactgcactccagcctgggcgagagagcaagactccatctaaaaaaaaagaaaaaaacatgatttgtaattatgtaaattactaattctacttcaaagtgccacacagccttcatgtgataaaatgaagcaattggtaagtctaagcattgagaaaaaacattatttttcccagctccattgcaacagttgggacagtgttttctctgtgcctatagaaacctcagctagtgtgccgaggagtctggtccctttggggaatgtggcagtcaggttctggcagggacctcgaagtggctggtaatgtctttcattaccaccaccacgtgacctggtcttacgacctgttagcttccttcatcaggcatgagcaccaggatggcaggggcctcatctgtcctgttcctcctgtggcctgggtcctagcaccatgtctggtacagtgtaggtgctcaagggaagtttactttatagaactgtctacctgggagatgttgctgttagtctaacctgtaccattttgtaaacctgcagccgttttgcacaccctggtcagaatgaaacattccttgggaactcgggccgtgagaagcatccttcctgatcacctgactgtagaaacatccttatcgcaccctcccgggcaaaggcccaacagcctgactgcaggaacatccttgccatatcctgccgggcagcaagctctaccgcccacacccctccttcccagtcccatgatcaccccagcctgtgagaggcagttggtgctggcagtaagctggtttcctcctctgcagggttttgctagtaataaaggtgttgctgttgaagccgtcaactgtctttctctgtctttctttaacccttgccttgccttcaaaatctaacaatagctctacctctccattttaccaaggaggatatgagactcaaggagagcaagagacttacccagaattacagagccagtgagtcacagaacttgaacttgagctcagttcagctgaatccagaactcatgtcttcctgagagtccagggaaggaaaggtggaactgcagccagtgggtgcccacaggcttgtcctaggagaccacatgcagcctcctgggaattgtgtcctcttgggcacaaaagaagaactgttcacctgtgctgcatcagctaagtgtccccattgtcccaaattgttgtattttttcaaagtttcattttagtaactagatttctcacagctcagtgttgaaaacaaagcacagaggcatatagaaagccgtgtttgggtttttctcatttttttcccagtgactatacaaatgaatgtacaaaagagcacaaatacgctcatactttttatatagagatgaggccccccccactcatattcctctgccactacccttcctttttttttttttttttttcttttcatgggaggacctgtctttcaatactagtccatgtgatttgggaaggctgacccaccctgggcaatcagatcagcagggtaattgattcaggagtggtcatgtgatccaagctgggctcatggaagtcatccctgaacttctgatgaaactgctgggaatgaggtgcttactttttattggcatatctatttgtaaggaagtaagtgatgtgaactttatggggccatttttgctgctctctcaaaacagcttgcctgaaaagcagagctgacacaggaaatgaagggacagaatgagccttggttgatattagttgacccctgatcccactgagacagaagcccatctactcatgtacatttttagtaagtaaagccaaataattcaatgttctgctggatccagttaggtttcagtcacttgcagtcaagagagtcctgcataatagcactttctgtgatgcttaggtcccacctgccagagctttagaactgtagaagggtaaagtgaacccaggcagtgctgagctagccaatctcctggctaagtgtgcaaaggaaccctggagtcactaccactttggtctgaaaaatagccttgcctgctgcttaccatacagccataggggtattgcttccctgagcctgtaggcattatacctctttttaaaaatgatgtttatttaagaaaatgttttgtgtagatggtgtcttgctatgttgcccaggcttgtcttgaattcctggcctaaagtgccgagattataggcatgagccactttgtttggccagcagtatacttctattagttgtcaatgcttttttgttctgtagtttctagtgtgtgcttgaggatgcgtgtgtatgtgtgagtttatgtgtgtgtatgtatgcgtgagagtgtgtgtgtgagtttgtgtgtgtgtgtgtgtgtgtgtgagtttttacctttatcttgcagggttattgcaagcatcaagtgggatcccgtaggcgcagtactcagtccagtgactggcacatacagtgagctctctctgttctcttttctcctcctgattcagagaatgacttaaggatctgtgacgtgtgccagttttcaacgccctgcataaataatggggagtactgttgccataactttgcactagttttaattcattttatctgtttagcatgagatacctcaaagtccctgaataaatttatgtcatatatatatatatatatatacacacacacacacataagtatgtttcttgagagctgacaagcttagttttggttccctgatgctgcagtagaggccactgtgttctgatttttgagtgatggctgccagctctccaagtgtcacagtcagtgaggcatccatgggggcaagcgccaaggatgagtgtggccagtcagcatctgcaagcccgttttgtctatcctctttatttttataatatgttttattcattttttaggtttatcatttaatctgttgtaaacttctctcctaaaatgtttcttagttctactaggggttagtttcatgaaacaagtccagaaatagtccacggcagccagggatacacaacatgccattggggagggagaaatcttgtagattgaaggttttgttgtagggacaatctttccaatggtcttcaagttgctaaacccaactcagggcatttcatcctatttccagagagcagcaagcagagaaagcaaagggaaattggtcaacaaaaaagaggaacaataactctcccctttccaaacagattttcagaaatccaaagcagtgaattctgcatttcacattggccaggactataagattcgctcactacagttacgagaaaaactgggaaactcatttaaagacgttaaccagggccaggcatggtggctcatgcctgtaattccagcaatttgggaggccaaggtgggagaatcacttgagcacaggaatttgaaaccagtccaggcaacataacgagacccagtctctacaaaaacaaaacaaaacaaaagctgggtgtggcggtgcacacctgttatgcctgcagtcctacctactcaggagtctgagctgggagatcacatgagcccaggagttcaagactgcagtgagctctgatcatgccactgtactccagcctgggagacagagtgagaccatttttcaaaaaaaaaaattataaaataataaaatatgcataaataaataaataaataaagacatttaaacagtgctccttggaaaaagtgaatctatgttcccttagtgaagaagatgagaataatggatatagcagggaaatggacagcattggccacattagaccaaaatgaaagtcataacaggtaccccaaatcagtaccattaaaaccacataatgtgaccataatgcagtcaaattgtgaccaacaaaaaacaaactgacaaaaaaggtatcatggagcatacgaattctaaatctaaattgaatggagctcagaagggcttcccactgaaaatgaaaccatgtgtatgtaaatgaattgtaacaaagctactacatagcaacattaaggtggcagagcggaaaggttgctaagacagatatctgtcatcttgtaccattttttaagaaaggaaaaactacaaaattatgaatttgagttataattgagggataagacaatgataaagtcaataattgttaacgtttactgtgcttcagtcctaccctgtgctcattcatgcccaataagtgaagagctggaactgaaagctttcttatatttattcaattgtagtctccctccagggtgtggaatcatgtataaaggagggatagtgtttaaagaggtattttctgcattttttacttccataagcagtctctgctgtgtgagttcttgtatgaactatgagtctgagacaacactgaggcttttttcatattccttactttcatagcttctctccagtgtgagaacaaatatctactcacgatgaatgaagatgaaaggctttccatagactttaccttcagagggtttcttttcacacttctgtaagataggagagttcaggaaagatgttctcatgcatgttaactcattgagctcccttccagtatgtcctcctcacatgttcagtacggtgaaaaattaatgatgatttccctgccactcacagggcttctcactattgtgaatcttaagatggcttttaattctggtgactttgcaaagtctttttcacatttatcacatttatagggtttcttccagtgtgactccttatatgtgcatgttttgagccttgctgaaggctttcccacattccttacatccatagggcttctccagaatgttctttcttaaatatttattaaggtgtagggaatatctaaagcctttctcacttttgttacattcataaggtttctctccagtgtgaagtttcatatgtctcataagaaatgactgataacgtaaaggctttccttcatttgggacatgtatggcttttctctccagtagtactactcctgtgtggaccagaatttggagcaggacagaggtttttccactttgatgattcttattcttcatctctacagaacagaactgcatctggacagcatggactgagttatttctgaagatgttttcacattgagtaaaattatacattttctccctaacatgagttatgtgtgccctaaggcacatgtcttcactacaggctgattcaaatggactccactcatgaatgtttgtccttgtattaattttactatgtatatgatggacattgttctgactgcctgtccatgtgtttgattttagctgtttttctcccatatgaaacccagtgaatgttgcacttcaagactatcatgttgattgttttcatatatattactttattgcaatagtttttgggaaacaggtggtttttggttacatggaaaagttatttagtggtgatttctgagattttggtgtacgcattactcaagtagtgtacattgtacccaatgtgtagtcttttatccctcacccccctaaccttccctctgagtccccaaagtctattaaatcattcttatgccttcactctctcatagctaagctcccacttataagtgagaacatacaatatttgttttttattcctgagttacttcacttacaataatcatctctaactccatccaggttgctgcaagtgtcattatttgattcatttttagggctgagtagtattccatggtgtatctataacacattttctttgtccactcattggctgatagacatttaaccttgttacacatttttgcaactgtgagttgtgctgctatgaatgtgcatacatgtgtctttttcatatgacttcttttcctctaggtggatacccaggagtgagctgatactaatttaaatagagataattataaaataaagtaatgaccaagtgaaaattaccatttctagtagtaaaacaagatacctttattgagtaaagcttgaacatatttctgcccacataaaggacatataacttttgtattttgtataaatgatatgctttatctcactagactcatcctatggttaattggtgggggatggttggagaaagtaacatatctttaaatttagcttcttgattcacatttttcttcaagtttcaatagctctcttttagttaaatgcctccaggaagatgttcagatgctttgggctttctgtggcctcaaggcaaagggaaagtgaatctgaagtctcttattgtcttcatgctgttctctagacctctgctttctctgtggcagagggtctctctggtctgatcgctggggccattgcattgctattctctgaggtgaagcttgtactctcgcatcagagtacagtggaattctcttgctttattagcctcctgttggcttggataagatcttcagatctctgtgagtttcagcatccttcttccacagtatgtctggaatggtcacatgggactttttggcaggatcattttgccccttggtgcagtggccccatgttatgtatgttagttttcaactcagttaagttgcttcttatttacctctatgacacttccacattgcatagattcataggtctagtaggaggttttttatataaaccaagctgccaggaacagaacaatgctcgcacagtaagtcagacaaaccaaatttattactcacagaggagcaggaagaatcagcaaaaccgttaagttctatggcaagcctgacccttgaggtcagaaaagttgcccagggttggtggagtctcctctgcacatgccccactgtgtactgcgctgaggaacccctgagtgctccgccctaggtttcacaccccacgtgcaccttggctctctgagtttaagggctgcagtaatatcctgttctaggaacaacaaggacagagcccagactgtcccagacggtttctactcatctcaggatattgtcttcttggaacattctaaagttattctgagaactaggaggtacagaaagctgagttggtcaaggccattcaggtcttgtcctcctgaccacagaaacaaagtagactataaaacaataagcattggcagaagtaatcatattgcattatgatagccattcttcattatgataaaaagaatttatcctccaaaaagttatctgagttctaaatctgaatgaacccagcaaaacatagatttgggactgttgttacagtttaataaaatatatactaaaccaataaatttaattaaatacataaactctagaagtataaaaatcataaaggctcatttcagtaaaggttggcatacaaagttatcagatgtatgacagagtaatagaaaatgttgacactgcttagggcaaagtgaatatgattgatattcagatgaacaaagaagatagtaaactcaatagaaaaatgggccaaaaaattcaatacattgttaacaatctgacaaatgcaaatgtacacaaataaaatgagatctgtattttcaccacttgcttagaaaatataagaatcctagataacattgagtgatgaggatatgaggaaaacaagctttatgggcaatggatggaaaattaaatggttttaaccatttcagaaaataacatgacaggacccatttgaaagtatgcatactctacaacctgtctcgatgatgggtacatatccctgatataatttggatgtgtgtcccctccaaatctcatgctaaaatatgatccccaatgttggaggtggggcccagtgagaggtattggatcatggggtggatgccttatgaatagcttagcacaggaatgtccaaccttttggcttccctggacagcattggaagaagaattttcttgagccacacataaaatacactaaaaatagctgatgagctaaaataaataaatacataaataaataaaaataaaaaaaccacacacacacacaaacacacacacacacacacatacacaaactctcttttaacaaagttgacaaatttgggccacattcaaagctgtcctgacctgcattcagcccacaagctgtgggttagacaagcttggtttagcacaatccacttgagtgagttcttctcagtgagttcatagagatctgattgttagaaacagcctgggactgcccccttctctctcttactccctctctgaccatgtgacacactggctccccttcaccttctgccatgattgtaagcttcttgaggcctcacccagagcagatagcattgcttcctgtgcagtctgcagaaccccgaaccaagataaacctcttttattaaaaaataaataaataaattacccagcattgggtatgtcttcatagcaatataaagagactaacatagcccctgacaaattgtaacacatgaccaaaaagtgttttcataaggataccataaggaagtgaatatttcagtagcaggatatcagtgtgaattctactgcaagactggatagggaaaatgtggttgattcattttattgaaaactatgcagcagctacaggggaataaacaaccaaaaataacctacagcaatgtgggaatgtatgaaggatgttatgctctgtgaaaaaattagaaataaaattagatttatagcacaatactctttaagcaaaatgtatacactcacgtatatacacatacacacactcagaaaacaaccttcttatcttgtaagaattctttaagagtaaagaacctatatcaaacacattagcatgcctgtctgtgacaagggataaggaataaaaaaatgaaacaagtaaaaccagagaaacttgtaggaaacaataatgataatgtctcatgaagtaaagaatgtgattaattttttgcaactgtggtataaaaacagattgtcaaaatcaaatgtaatgagctttagcatagagcttattgtagggaaaaaatcaaatttaaatacttagtttatatagtttgatgcaggaatggtctcctatgtgaagtagtaagatacactaaacaatccatgggtgtatgggaagaaaatactcaaaatgctacttacatttattttttactcatttttccaacagtttaatatctaaatgctaggggaggccagatgtgatgactccctgtcattacacctgtaatcccagtgcttggttggagagggtgggggtcaaggcaggaagaacacttgaggccaagagttctagaccagcctgggaaacctagtcggtttttgtgtccacacacaaaaaaattaaaaattagccaagcatgatgtcatgcacctgtagttccatgtactggagaggctgaagcaggaggatcacctgagggaggagtttgaggctgcagtgagcaatgattattccactgcaccatagcctgggtgacagaatgagaccctgtctcttaagtggaaataagtaagtgcgaggagaacacgtgatctttctagttttcagtccctcttgcagttccctgtagattattttgcttattcccaatgttccagctgtctgcacattgtaggcttgttcttctacctactcaaggccccagatccagcaaatgtcctcagagatgggctctgctgctaatctgtgatcaccaaggaagggcttgtttttctctgaaatttagttcattgacactttagacccacaattttttgatggctttaaacaaaaaaaaaataattttttaaagttcatccgatattttctcattatggcaggagcaattgtctttggtaactttattttaattggaagaagaatttctaacattggcattgtaatgaggtttttggtctttgaccctagtggagcaattaaatccacgtctatttcttctgttatgcatgtattgaaggatcaaatgagaaaatatatgtagagtgcacaaagtgtctaatgtacactagtgatatacagttgtattatgactacacaccgaaaacacataatcaaccagattgcttcctgagaactagagccaggcttttccaatgatacttaactgtcaaataattctattcaatttttcatgggacttagggtttggtccatgaagtgctgccacagtatgcaaatcaattatatcaataaatgtgctaatttattcagcaaacgtattcttgtagcaatagttactcaatgaaagaagtaacatatttaatttctagtagaagctacttctctcattgtgaactcggtacaaagcttgaatgctctagctattttgaggagcattaataagcattacctaaagaagatgatatattccctagacaacaagaactcttatttctctttatcttctttttgataaatgctacagtctcttggtagtgaatccagattctgtggtgtggggaaaagaaagagagatcagactgttactgtgtctatgtagaaagaagtagacataagagactccattttgttctgtactaagaaaaattcttctgccttgagatgctgttaatctgtaaccctacccccaaccctgtgctggcagagacatgcactgtgttgactcaaggtttaatggatttagggctatgcaggatgtgctttgttaaacaagtgcttgaaggcagtttgcttgttaaaagtcatcaccactctctaatctcaagtacccagggacacaatacactacacactacggaaggctgcagggacctctgcctaggaaagccaggtattgtccaaggtttctccccaagtgatagtctgagatatggccttgtgggaagggaaagacctgaccatcccccagccagacacccataaagggtctgtgctgaggaggattagtaaaagaggaaggcctctttgcagttgagataagaggaaggcatctgtctcctgctcgtccctgggcaatggaatgtctcggtgtaaaaccggattgtatgttccatcaactgagataaggagaaaactgccttaaggctggaggtgagacatgctggctgcaatactgccctttaatgcaccgagatgtttatgtatgtgcacctcaaagcacagcaccttttctaaccttgtttatggcacacagacatttgttcacatgttttcctgctgaccctctccccactattaccctattgccctgccacatccccctctctgagatggtagagataatgatcaataaatactgagggaactcagagactggtgccagcgtggatcctccatatgctgagtgccggtaccctgggcccatgtttctttctctatactttgtctctgtgtctctttcttttctcagtctctcatcccacccaatgagaaaaacccacaggtgtggaggggcaggtcaccccttcatgtgggatgtacaaaacaatcctccacaaatttaaatttatgcctatgatcatgtgtaatgaaattagccctcaagagccaacttgagaccatgttcagaatgaaagcttcagaaacccatggcaaacacatgaatataaggccattttagacacagtccccagattacctctgaattcagtggggaaaaagtgacaaggagcaatatttagggcatctaggatagtgctaccttctcatccctaacataagccaaattaaaacttcatactaatgctctgaagcctaataataactagtaaggtttatgtctgtcaaaaagccactgcaggctactgttaaaaccagctacacaaccatctggaagacatttgcctccttctggttaaaaacagtcccatgtctactgatgatgtagttaaggttgtatcaagatcttctatctctcagcagggatgtggtttcccaaatgctaatatttgaccaacaaaagttttgcagccagagtttgtgcaagtattggtagatagaaaatacaaaatccaaccatttctcatgaatgattaaacaaaaaaaagaatgcaagaagcctgtgtgcatgtgcgtgggtatatatgcatgtgtgtgtgtgtattcaggtttgttaactttattaactttgtttaaaatttaatttaaaaattagattggggagtaaatatcattcttcctctctcatcataaaacttttggctcacgggattctgacattccatcatgcttggaaaagttggatttatgaaaccagttgctggactgagcctgcctatgcagctcttacatgggtgctccctattttgtgcacaagcatcctcaagagaccaaagatagtgattgagagagacgggctctgaagtctttttatttcaacttcttggaatcaccaccttgttaatgaacatcaaaatcttttgtgtcatttatcagattaattactttttccataaaaagagtgagttgagaggataacaagaaactccctgtccctgcttcatcctgaaaacaggagaatcaatatcttaactctgtttttgagagatgaatgggtaggtcaacattgcttggctatttgtccttccatttgggacagattaccactgcactttcccctcaatctctagaatcatggcttatagaaaacaattttgtactgaattactaaatgcatcaaaactttattagacttattatcaaagagcatgctcagatgtatctattataaatagtaataaaaatataaaaacctaaaaacaatattataaataacagagaaaagctatgcactgttatgaaagcctttcatatttagggatatcaggtaaggtttcccttggtggggaagatgaagagcaaactaaaataagagtaagagctggctgggtgtggtggcttacacctgtaatcccagcactttgggaggctgaggcaggtgaatcacgaggtcaggagatcgagaccatcctggctaacactgtgaaaccctgtctctactaaaaatacaaaaaaaaaaaaaaaattagccaggtgaggtggcaggcgcctgtagtcccagctactctggaggctaaggcaggagaatggcatgaacctgggaggtggagcttgtagtgagctgagatcacaccactgcactccagcctgggcaacagagcaagactccatctcaaaaaaaacaaacaaaaaaacccagtaagagctaattatataaatctgggatggtagtgggaaaagcatatgagtaagaagaccaaagtccaggagacaagaagaaatacatctgaatcatttagttcaacaatgttcatgccacaagaggggggaaagagaaaggaaacaaattttgtactgcttgaacccatttttggactcttgctatttatcctagtactaatgtgaagtctttgggagtttttaagcaaagcaatttacaatgcaaattgtatttacatttcaagtaatcattccagatatagcacagaaccatttttggagagagaatcagggagagcactttagaggtgtgcaccatagcccaggtgagagagtgatgggctggaatccatgatggcaatgaagatagaaagagaaaaattcattcaagaaatagagagaaggtaaaatctgacaatacttggtgatttgaaatggaaatgtgaagaagaaaatgtcaaaaattaattgagatgtcaggtgtaggtagaagttgacatcatttgctgcaaaaaaaaaaaaaaaacacacaagaagaataccacttttagtgaaagagacatctaggttgcttaaagtatgaaacaggacttttccaatttcatgcaggtaaattaggagggctcaaccttgaagcacaaaagatggtgattatggtaacactggccttgagaccaggacctgtatcagactctagaaagatcagtgtgatttggagctgctacagactggaatatttcagtgaaaaacaaaacaaaacaaagcattcactcttattcttgcagtcttgttttatttgaaggagtaaataattgggccttattcagagctgcaagttttggtaagccctaaaatgaacaaaaaattgtataaaatggaaacaattcaccaattctattcacttaacattttctgattttcttccaggtttaagtattatgataggcattgtacagtaattactttattgaccatcttctctggtgtttgtattaatacacaaagaaatctaactttaaaattgtagcattgctttcagctgacaccaatcattacccgttatcccaattcattaaatcagattgtttcagcaataagttacattttgaagttaacgaaatacttaaaaggctgtgatgttgtagctgcagatgtagtatgcaaaacacatttgattcatgtcgttcagcacaatttcatcttaaaatcttatctacaaaacatttttacacatctattattctcttgctttatgtaaagtttatgtcatttatctctatcaaattaagttacatttctagtttttctcaaccataaaagacagcattaatttttacaaacattaatgatgaactatattcactcataactatttatgtctaagtcatcttagatttactgaacaatttctgagtaactaatggctagccttttattattctatgatgataaacatttttacagtatccaggcttcagacatatttttgaaaacatttctatatgggtcaaaatttaaatcagttgtaatatgtgatccactcaaatatattctccaggatgcgctattaaaatgaaataccgaggtggttccccaagacaccaatttaaagtgtatatgtgcagtgcagggttactggaccaaggcacagtgtaaacagtgaaattttattttttgttttctttttcctaagatgtttcttattccccattatataaaaatatgtattacaggcaaagaaaaattaacacgaatataagtaaatataaagtatattcacattaatatcagctttgctttatctattaaaggatgtaacacacttgtggttttcaggaccttgtaactcctggttcattggaaagcatagaaattcttcagagcctcaagagttgtgtttaacacattatttaaatagtgtccaaccactagttagatagcttagcactcaaatagcctttgaaatctctgtagactcacctcaattgaggagtcctgataatttacagaagtgtgtagtgcactaagagatccctgatggataatgtctttgcctgtggagtgttttatgtgttgatccactggagtgtgtgtgtgtgtgtgtgtctgtgtgtaggtgggtgagtatgggtgggcgtggattgtgtgtgtgtgtatgtgtttacactgtggtatgtgtctgttggggtgccaccatttgggatttggaaaagtgaggaccataaacttgtcaacattcctacatgcctgcttcataagaagtgtactgaacatggccaaaagtaactaaaccaagtaaacaaattagacattaattaaatttaatgctgggcgggaaagaagtattcaaggccaggtaaaatgaagaaatataaccaaatgaatgaaatttttagattgattcatagaatgagacaggaatattttttaaaatttgtagtttctaatgaataacagcatataaaataagaatcatatggctgtcaattgactaaaaactgtacataagatttgagctagtgaaacaaccatatatgatcttctaattccacttttctatctcaagaatgacttgttaaaatgattttttttttgaaattttacattctcatcttgaaagagcttcacaaaacttacatgagaatctggattgtcataagaggtctgattttttaatggtatgtttgtatttttgttatgtacatcaatgtcaagcattcgtttcctgagctgttctctacaacacaatttaacttgtaatggacactcagtaaatggtcggttggatattcaaatcaacaccttagttccatcaattttcacttcatataaaaatgcctgatcttctatactcaccaatgaaacagagagagatgaaggagggagagcagttgagactgagaggatgacaagcagacctcattctgcagtggatttcctacactctccacttctgaatgcttggaaacacttgccatgctcaaaaaatattggtatttcctaggcagcaaatgggagttaaagaaagtccatatttctatattacaataacttacactataatacacagatggcatacatttctaagctatttcagttcacagaaaatgtagataaatttaggtgagcaagatgtaagagaagggttagtaatcaagctgagtgtgattgtgagattaaatctaatattatcttatacaattattgtataattgcatcagttgacatatctgttgaaacagaaggtgggagagttttgcatgcgcttccgaaatgtactggatgatgttaggagagaggcgggtcaacgtggctaggccataagtgtttactaattgaggcttaggaaagttaagctcctaaccagagactgggagatagaggcgctaaagtgtataacatttatatttaatatataattaataatacataataaagtcttaaaatgccagttttaagtcttttcattttcttcttaaaaaacagaggttttattgcgtttggtccacagtcggtatttcacattatctcatagcgcagggcccctgggtggagggctctgtgtagtacttggcgtggcctggggccgggagagatagagcagtagacctggtcaggcccggaaggggagaaggagggccggggctccttaagacctactgagggcctgggcgcggtggctctcgcctgtcatcccaacactttgggaggacgaaacaggcggatcacatgagggaaagagttcccgaccagcctggccaacatggtgaaatcccgtctctactaaaaatacaaaaaattaggcaggcgtggtggtgggcgcctgtagtctcagctactctggaggctgaggcaggagaatcgcttaagctgggaggctgaggtgcagtgaggcgagattactccactgtgcttcagcctgggcgacagagtgagactacatctcaaaaaaaacaaaaaacaaaaacaaacaaaaaaccctactgagggccacgggggtgggggagctaggatggagaggggtcagacttaatcctggcaactcagaattccactaacttgtacgggtctcagtttcctcaccgggccccagcataggtctgagggtctgaggtctgtcggtctgagggtcctagggaaatccagccactcaggagcctgagatattttagcatcgtggctgggccccctctcccaggggactcatttcccagcaccctctccactgtctccgccccattcctcggagaagaaaaaaattttctttcttttgttaatacttcctgaaacttttgcaggtacagaaaccacaaactgatcggctgacaaaaaggggaagaggagaggcaaccagaaaccttcggggactggttccctccatgcccaggtctcttctccccagcacagctcagcccacagcctggaagtgccagcggggaccttcaccctacacgcatcaggatatggccttgatcccttcccccacagcccggtgtctcagtcctgccaaggaaccaaagcaagaggaggtggggaaaaaaccctgctgcctgatcccacgctgccactcacagaccctcggttgactggcagcactgaacaggttaaaaaaaaaaaagatgaaaacacagaaaaacccaacacccagacggggagaccatgtgtggagagagcgtgctgggagcctcagtagccggtctcctcctggtagtaaggggcctcccctggccctgggcagttgccggcggagggagccccgtgggccactgggccacctggctagtacttgggttcgtatatttgccggcctaggccaaagacctggccgctgtgattggcaacctacgtgtagcccatcttcagggacatggaggagttctcacacttgtcgattcccaacttggtgtcatagatgtgccgctgggtcccgggagccgtcatgcccacctggctggcgcacttgtttgtacccatctggaggctgatggtcgaattgtccatggggggcaggatgcggttcttggggtcgtagagatgcctcctcgtgccatatgcggtcatgcctgactggctggcacatttgttggtaatctgcagccggatgacgcactggctggccttcatggtggtgtcgtcgaagttctgcttctctgagtacttgtcacggatgtccaccccgctccgcagccccttagtcttggccttccctgccagggcgagaagagacacccgcacctgcatattgttcccactctcaaacaggttgttggcctcaaataggtccacgggatcatgccgtagctgaccattgccttgaggaagttggagaggttttctagctagtgccagttctacacggaagccgttgatcttggggactgagcccggctgcagtttgttcacgagtgtgcataaaataatcccgtccttcaggcccttctggaagtcggggcggatggagaggccagtgaatcccttgatccagctgcggagctctgcctccttctgggagtcatatttgggcagaagcctgttctggacgtccgccaagagcctgtaggaggggcccttgttgaactgcgtggagcttacggctggagggccaccgcggggcggatccgacaggaccagcggctaagtcttttttctagttcgcaatgttttgttttcaccacaccattgttttactacatattttattgtatgtgtattgtgttaaatatacattttgtgtatttaaaaatgtgtggaaaatgttagaccatctcccttttttccaccttcccttttaccctttactgccatttacatccacacatccacacacacatacatccacacatccacacacacatacatccacacacacacatactgaccaaaattaatttcgatatacgaatgggttatttgaagcgaaaagtcaatctatattagtaaaagtgtcatgccagtatgaattatatttataatcctttcaagaagaaagaacttgcggcggggcgctgtggctcacgcctgtaatcccagcactttgggaggccgaggcgggctgatcatgaggtcaggaattcaagaccagtctggccaagatggtgaaacttcgtctctactaaaaatacaaaaaaattagctgggcgtggtggcgggcgcctgtaatcccagctactcgggaggctgaagaagagaattccttaaacccgggaggcggaggttgcagtgagccaagattgtgccactgcactctagcctgggcgacagagcaagactccgtctcaaaccaaaaaaaaaaaaaaaaaaaaaagaaaaagaaaaagaaaaaagaaagaacttccttaatgttttgaagagactattctgtatccattttataattttgtggccactgaaaaaggtatattaaatcacagacacagtgaatgtagtaagtggtagtttaaaatgttaaaatgttaaatcacgcctgtactcccagcactttgggaggctgagcggggaggatcgcctgaggttggcagttcaagaccagcctggccaacatggtgaaaccccttctctactaaaaatacaaaaattagccaggtatggtggcacaaatctgtaatcccagctactcgggaggctgaggcaggagaatggcttgaaccctggagggggaggttgcagtgagctgagatcaagccactgcactccagcctggacaacacagtgaaactgtctcaaaaataaaataaagtgttgaatttttacaagtcgttgttcctattctaatttttgaatgcaaccacagcctctaacaaaacagcctcgttacactaattcgctgataatgaattcttaagtaaaaggggaattccatagaaatatatatggctcttttatgtttaagaaaagtaagagcctgaaaaacagatgtgttctgtaaaactgaattactttctatccagttccactggttccactgttttatatctttatattaaaacatatataaatgattgattgatgattttttttcttttagacgctgctgctgaatccatggagagaaaaaggataaatttccagaactatggtccctgtgctccagttcgtcaggcgggcgcggcggagacggagaccgaggaacgccgctggggccatgcggcgctaccgcgcgtggtggctctgtgtctggcctgaggcttctgctcgctcctttacgccttcagccagctccccgtgtccccggaggaaggagcgggccgtggtggcgggaagccgcaggccgcagtggcttcctggctggcgggaggcggatgcggtgcggtgagaggcgcgagcagcgcttgtcccgctgctcatccccgcaggtgggacaggtgtagtctgaaaatacagcctgttgagaaaatgtatctaggtgaaagactggaagaaactatgaccatgttgaagtcagctattattttcaggatcaaacctcttcaattccagatttttgctgaagatcaactacatcatagctttaaaggaaggcttgacaggggtcatttctacaaatatttaattatacaatatactccataacctttccaagtgagaatgcagcagagtggaaaaactctttaaaccatgtggtttgcagagattgtccttgccgttattcctgaaagaagttgactctcacactgatagcctttttaaaagaccagctgataatatttggtctttactaaagaaatttaattccacacaaattctgcaatggccccagaacacaaggaatgtcaaataggatggtatagtcgctttgctaggcatccatagtgtggaaaagctggagtaaactctggagttatgttgacaaacatgacttgaatgagaaggaagtatttcaagaataatatgacaactgtgtgactacaatgaggagatatacttatgacatggcttaaaatatacaagttaaacattacatgggcgatcaagatctgttggatatcctgttttttcataatccagaaagcctttttgtctttccgtgtcaatggaagtgtcgtccagatcactgtctatatggaagcagttgccaagaagcagaagaaggaatctttatttttcacgggaacagaggtgtttaccatgatgataagcaaccagcatttagagctgtttatgaagcactgagaaattgttcttttaagatgacaatgttcattcattaataaaacctttagaattggaactacaaaaaatagtgcatacataccgtggaaaaatttactaaatatttatcaaacaattagcaaaaacataagagatcgctatgtcagatcaccaaaggaaaggtgattcttgttgcctgctacatcaaatggatgaaaagaacaaagcattggaggataagtatgaaggaactgtcttgggtgaagcattaaggcaggaattattcatctacagaatttttttttttcctgaagaggttaaatgagcagtattttcaggtaatgaagaataagttaaaatcttgggcttcaacaaagaaaaatttttggcctctgatgttgtgtaatgttacttactatcattccagtattgatgaaaatattattgaatggttttagcctgcaaacttctgttgactcatactctcaagagtggtggggctgtgaaaatgaagaaaatgtacctcaaacacagtgcaaacactcagatggtgagtagagcgataattttatgtcagcactaacctcactttaaatgtgtgagagagaagtttgtctacaggagtagaaacagttctgtttctaaagaaatgtgatgtaaccaatgtaaccatggatgatctatatctgcctttacacatttcatctctgttttaaaatatttttatgataatcatatttaaaattgtttttagattataaggaagctgcatgttaaaaattgagctgtataagaaagaggaaatatagtgaaaactttggggttttaatctgtgcatgtgagagagagtgagaaatatagtgttttcattgtgtatgcattaaactgtcttgctaaaactcagatctaagattgttaagtagatatttggggaacttttttatcactttaaatgaaaaatttcagccttactgggcattctggaagcaaaatatgttatgctgatgataaagtgagaaccttaagaatacactcatttgatggcggaaaatgtgatggaccaaaatgcagaagctatacacgtcctgtgagtagtaattttagttacaatgcagtaggaaaatgtggcgcatttaaacatttcttctacctcataatggctttgcaagatacttgtaaagaagcaaatgtctagagccttactttaagaaagttaaacaactttggtgaatgatttggattaagattgttacatccagctatagaaatgtggtttcaatagggttgatgtgagtgagtaccttccttttttgaataccacttaaaacagttaactttttaagtcttgaagatgagaaaaatattgcttatctaatataactattttaatagttatctaatttatagttatctactataactatacattctgaatacttagcatgtactgtgctggggcacatatcttattttcccagctgctaaacgattatcttccttctctccctggtattttaatgcccaagtagaaaatggaaaatcatgaaggaaaaatatcacttgtgaaaatcgtggcagttagctttatgaagacacagtggcctctgtggggacatgggatatgcagaaagagatggctagtacagttgttctgtcttctgcagttcagtcagggacatattgagagaggaaagtttaagcaggtacattagaaattgataaccagcccagcattcttagaacagatgggtttagagaacacgagttgtagttccttggcagaatgccatggtggatatgagaaactgtgaactgtgttgaaattgagcttgagcagaaaatgagaatactaaaaatttgaagttcagagggtatgcattagattatttctaatggtccccatatatgatcattgcctgcctgactatataagactcctgttgggagcttgagaacagattgctgagcttagccctttggagactctggtatgctgtgtctgggatggagtctgcaaaaaaaaatttaaagaagagacttaaaaattatacaaaactagaatagtgctttggtactatcagattacttgggggctattcccacttcgattcttcatatagaggatgtgaacagagaaacatgcagataaatcagtcaatgccaactgctgggggaaacgtccatagtctgcaggttcccacagaaaggatagcacttccgtcctctcccatgagggaaaaacaaaggagaaaagcttttggcctctcaccataagctcattcagtcctccccttgggaagagaaatgacttaactgaggaatgtgcttgaaagtagctgtactggtgaaactcagcctctgtgggtttctctctctttcagagtcagctctcttcaggatgcgcatttatttctccctttggaggaggcctcagtccagctcagccaaggactgaaaggcacatctggctaattcaagactgaggtattgggaggtccccttggccccagatctatgatatgttctcgagtcctgagacctgctgactctcgtatctcttttctcagttgggtcatatcttggggttatttgtgttcccagctctaacaggaaggttcctaagcactcatttcttcttaaccaatttctgaaggtaaaatgttggtgaagagtgctcttttcttcctgctaccattaattggtgtttattttgtgtcaggcactgttgagtattttacatttcttatccagtttgatctttacagcaactttatatgacagacattgttcccccatttttcaggctagaaatctgaggcccagtgtcccacaatggctgtgtggtgacactaggctttgagcacagatggttgacttccaaagcctatgttcctaaccattatgccactctgtgttgtgacagcgccaaacatactttcattcatatatatcttttaactgatcatgttcttgtgtgatttctttcagaaaggcttttacatcaaatattgataatgataataataatgaacacatgttgagcacttaccatgtctcaagcactgctctagagcttcccatgaaagaacccctctaatcttcagaacaaccctgtgaggtaggtgctgctattactctgttttcacaagtaaagaaactaagcacagcagatccacagtcattctgtaggatgctgtgtagaatggctcccgggacactgggaaagctcttctgcacctcagtatcttctttactggttcattaatgtctgatattcctgcatgagaaagcacaacatagacagaaagcttaatatgtatatacacacactgagagataaggcattgacataacatctcattataggtattagaaatgcagtctcaagagcaggttctcgtggggtgacaggcagggtattctaggggaaggaatatcccaagaaaggtggcattacaaaggaagaggagaaagaaagatgtaaatgaggagacactgattttcttccattgcaaagttttccaaggctggccccttttctattacattcttacccagtaactcatactttccctagagctcttgcaagaaagaactattgagaaagtagcccatctgaaagtacatttcctgctgtttatctgcttccagaactggctgaagtttactttttggttctccagagacctagcttcttccaatgtggtctatttaatctcctgtcatgtgggaaattatattcaaaatctccatgatcctctgtccatagtaagttatgcatgtagtgagaagtacatgccacaaggtcttgagattatatctgcaatgtgttgctgctggctgttgatcaagataggctgggagaagatcattttcaggtgtgaaaaactgtcacctttatcaaataattcttcttgcatatttcccaagacgttgtagcctgtctaaacttgggaggttaattttgtagcattcattatgaccgaaaatgtagttcacacaatcatgatgctctctttattaggtgttactgttaaacaatattaaaatacacacaatgtggctggtcttttgtaagctacatggcatgtttacttctttgccaggtttcttaattgcatctcttcatctttccgaataccagtgtcactgtcacccacaatatttgctgttttgagcacatggtttaccttttattttgcccaataatagaatatgatggggacatcttatctgagtgtttcatagtatgctgtagtttgaattcttggctgttggtttcccagagtcccagctcctgccactgcattctgcctttgtaaatggagaataatggctctaaaaaaaattcacctaagaatgtcatgatagtggagagggaggaccatggaaatgctaaagccacccactcggcttctgtaaatcatgcagaggatcaggaaaatgattgaaagtaacgtatcccaaacaaagcagtcagctgtacaattcaagacctgtgtctggctgtaaaaaaaaaacaaaaaacaaacaaacaaaaaacacaaacaaacaaaaaaatggaaagaataaccttgctactcatcttgttcaaaaaactggagcagattgagtatctagactcagtttcagaagaaatgttaaatattgacaggggcatattcaagatctttaggattttttggggggaggagaggggaacataaaaaagcaataataaagataaatttgaatgcaggaaaaatacacataatccatgaatctaacacctgttttcgcatgtttatcatctttgtccctatgtagatctatgttttctttcacagttgcagtcatagaatatattctattctctaagcttttatccttcaacattataggagaatgttgttccatgttaccacatagccaactgtttcaaaacttgtctagtaaattctgtgctgttgttttcacagggagaaacatgcacatgtatattacttttttttttctgttgaatcatactcttggaataaatttttttcagtgaggtttttggttccaaaaagtataaacattttggtgatctttagtaagttgtattgctttccaaagaagtgataggaattatacttgccaccccaacagtgaaagaattgcaatttaatttcaatgtaaaagaggatgctactgttgctattatattttctattataatgaaaaccgttaaagatttaaatcaagctggattgtctttcaggagctgctgttaaatgaacaccttgatactttcgttcttggagagaaatgagccaaggaggaagaccatctaaaaaaaaccactagacaatttgtgctcactggagtggtctctgctgggcaaaaggtctttagaatgactcgtggattttctggcaagtggcaaaccatacaagtgctatgtcaggccagggagacaggtgcagccctgtcagtgtcaaagaagaacactggtagcagaagagctaagagtgaatgaaaattgaattatctttatttctaggacttgtctattgagaaacaacagtgctggcaaccatttactaccaacaagaggcagttccaagagaagaatataaaatatgctctgctcaatcccacgaaactcagagtgtctcacaatggccaatttcttatttttatcctgtccagagacaaggaaggatgcatcagggagctgctagcctctgcgatgaataacttgagtcaggctgcaacatgtgaaagaattcagctggtcaggatttataacactagctggattttttgctttctttggggttcatgaagcatggtgttgtgagataccacaggagtcccagagtaaagttacatacctatttctcttccttatttttatttttttggcatgttcatactattttattaccaacatcgttggcatccctgagtatgagagttcagaagaaacttagaggctattgtctgattcaatccttgcagcttacaaaaagaaatgtggggagcagtcactgtgtgactagcctgaggtcactcaggaagttagaggcagaactgcagccagggtcacctctctttactgctactagtgtgctccttctactgcaccctgatcataaaacatctcccaacccaggaacaaggtctaccgcataggtgggcacagcagcgtgatcactctctcagtcgtctgtactcctcctttgctttgaccaaagacacaggaagggaccttttgccccacataaaacacctctcagaggcttggcaacaacaacagataatagagagcattgacctaagaccaacatttcaaccatggtgtcaaaacaatattttatttcagcaaagaaaaactatgtcacaagtggattattattactaataatcagactagtggtacttgcgaatgacttggtttcatactcacacttggacaactatgcacactgagtataactgaccttatgagaacatcattctcactaagattatgatgtgctttctcacgtgggaactgtacataatattgcgtgtacacttgggaggatgtcctgcctgtgatgttgtctttcaggggaagaagaatggttgagaactgagggtatattaaacatttactcctccagatttttcaagatttctgttaagccagatcagaagaaagccatctatttggattgcatcactctaacctggtaagtcgaattgtctacacagaattataatttcacgatatgtccagattacttaccaagagccaatttgagacaccaacaggactagtaaaacatctttgcactgtgggtagcgttgctatcaaagaccttatacattatgccattcaagaacctttatattaagatccttatggaaaatccttcccaaagtttaaccctatgataaagggtttttttctcctggtaacatagtgggcaattgggaactgtttaacccaatgcattgatttcattgattgttttggttgccgagaagtatggatgctcagaataggttttcttgttttcaactgctaattcctttatttaaattgtaataaatgtttccctttacttctttcctttttctttttaagaaatttaatgtatttcataataaattataaattatcaatagatcaattagcatagaatagtttggaataatgcttagagatctcccattgaaaaagaccccagtaccatagggttcacagctgagtgttaactgaacttgaacaaattctgattttatttaaaatgttcaaagcctagaaaaaaaactcctgcagatcacatggggcacataataactaaaaaagaaagaaacaaagaggggtggctttcttcaattaattttatagtgtaatatcaaagcttaatagttaatatatttcatctaatgtagaatgtcaatgtttagaaatcagacattatttcatgtaccattagagatatactgccaattaaactgtgacttccttagcaaaagcaaaacaaggaattttaaagatattaaaacatgtaaagaagaatataagcactatactcccaaccccttcaagtaacatgttaatattttattgcattggttttcagtaattacttttaataaaataaatcattattagctaatgttccacccctaccactccaatctcattctccttctaggtcccccaggcccaattgctaaaataaatttgttgtacactttaaagtcaattttctatacgtttgcacataaatatgtgcattcatagaaagtatttttgtgccgagaaggtagaataagcccttcaaagttgttgatgttcagattccagttggcaaaagtcttacacatgtggcattaaatattttcagtattaaacatgcacattccacaagttcagcagttctgtaatatacatccagagtctgccctgagggatgcttacaaccttagtataaactctcactcaccccttttagagaataaaacttacacctatgtaatgaccagtccaggtacaagggtgtcctctgagaacattcaggagaaagagtggtggcatcggcaggaaagtgcagtggaaaggaggagctgactttggcaggaaaaagaacgatattactttgaatttatcaactctgacgtaacatcctgataaaaagtgccatatccaaatcacgttgaagattctcaaaggacagtaccaaagttgaataaaaacacagtgcctcaaatgggaagtggtatagaaaggcctgaggctggggtatggaggcacacggtgtgccgagaacgagggaagagaagagtgaacaactgctcggggtcgggttgcattgatggcgagagatgggtgtaacatgcatttatgaggacagacatgatcaggtttaaagaaaaagaattttttctttttccagcagtcccactatggggcatttatctacaggaaaggaaatcagcatatttaggagatacctgcaccctcatgtttatagcagccactattcacagtagccaagattagaatcaacctaaatgtccaaaaacataatagattaaaaatgtagtatctattcacagtggagtactatttagccgtaaaaataatgaaatcctgtccttggctgcaacatggatcagcctggaacactacattaagtgaaataacctaggcacagaattataaatcttgcatgttctcactcatatgtgggagctaaaaaaaaacgaactgagctcatggaagtggagagtagaattctggttattacaggctggggagagcaacagggagaagaggacagggagaggttggttaacaaatacaaacttacagctagataggagtaatgagcacacctatgacaccaagctgggaatcgacaagtgtgacaactcctccacgtccctgaagatgggatacacgcagggcgctcatcagagcggccaggccttcggcatgggcctacagatatacgaccccaggtactactggggaggcccagtggcccacggcgctccctcgggctccggcccctgaatatctcccttactaccaggaggagaccggctactgaggctcccagcacgctctctccacacatgatctcccctctgggtgtttgggtttttctgtgttttcatctttttttttttaaacctgttcagtgctgccagtcaaccgagggtctgtgagtggcagcgtgggatcaggcagcagggatttttcccccacctccccctgctttggttccttctcaggactgagccaccgggctgtgggggaagggatcaaggccatatcctgatgcgtgtagggtgaaggtgcccgctggcacttccaggctgtaggctgagctgtgctggagagaagagacctggacatggagggaaccggtccctgaaggtttctggttgcctctcctcttccccttttctcagcctatcagtaagtggtttctgtacccgcaaaagtttcaggaagtattaacaaaataaaaaaaattttttttccccgaggaatggggcggggacagtggagagggtgctaggaagtgtgtcccctgggagagggggctcagccacgatgctaaaatatctcaggctcctgagcagctggatttccctaggaccctcagaccaacagacctcagacctacgctggggctccttgaggaaactgaggcccgtacaaggtagtggaattttgagttgtcagggttaagcctgacccatctccatcctgctcccccacctccgtggccctcagtagggctttttgtttgtttttgtttttttgagatgtagtctcactctgtcgcccaggctgaagcgcactggagtaatctcgcctcactgcacctcggcctaccgggctcaagcgattctcctgcctcagcctccagagtagctgggactacaggcgcccaccaccacgcctgcctaaattttttgtatttttagtagagacgggatttcaccatgttggccaggctggtttggaactctttccctcatgtgatccgcctgtttcgtcctcccaaagtgttgggatgacaggcgagagccaccgcgcccaggccctcagtaggtcttaaggagccccggccctccttctccccttccgggcctgaccaggtctactgctctatctctcccggccccaggccacgccaagtactgcacagagccctccacccaggggccctgcgctatgagataatgtgaaataccgactgtggaccaaacgcaataaaacctctgtttttaagaagaaaatgaaaagacttaaaattggcattttaagactttactatatattattaaatatatattaaatataaatgttatacaatttagcgcctctatctcccagtctctggttaggaacttaactttcctaagcctcaattagtaaacacttatggcctagccacgttgacccgcctctctcctaacatcatccagtacatttcggaagcgcatgcaaaactctcccaccttctgtttcaacagatatgtcaactgatacaattatacaataattgcataatatcagatttaatctcacaatcacactcagcttgattactaacccttctcctacaccttgctcacctaaatttatctacattttctatgaattgaaatagcttagaaatgtatgttgtctgtgtattatagtgtaagttattgtaatatagaaatatggactttctttaactcccatttgctgcctaggaaataccaatattttctaagcatggcaagtgtttccaagcattcagaagtggagagtgtaggaaatccactgcagaatgaggtctgctcgtcatcctctcagtctcaactgctctccctccttcatctctctctgtttcattggtgagtatagaagatcaggcatttttatatgaaatgaaaattgatggaactaaggtgttgatttgaatatccaaccgaccttttattgagtgtctattacaagttaaattgtgttgtagagaacagctcaggaaacgaatgcttgacattgatgtacataacagaaatacaaacatgccattaaaaaatcagacctcttatgagcatccagattctcacgtaagttttgtgaagctctttcaaaatgagaatgtaaaatttcaaaaaaaacatcattttcacaagtcattcttgagacagaaaagtggaaatagaagttcatatatggttgtttcactatctctaatcttatgtacagtttttagtcagttgacagccatataattcttagttttatatactgatagtcattagaaattacaaattttaaaaaatattcatgtctcattctacgaatcaatgtaaaaatttcattcacttggttatatttcttcattttacctggccttgactacttctttcctgcccagcattaaatttaattaatgtctaatttgtttacttggtttagttattttggccatgttcagtacacttgttatgaagcaggcatgtaggaatgttgacaagtttatggtcctcactcttccaaatccctaatggcggcaccccaacagacacataccacaatgtaaacacatacacacacacacaatccgtgcccacccatactcacccacgtacacacagacacacacacacactccagtggatcaacacataaaacactccacaggcaggcatcgtacagcagggatctcttagtgcactacacacttctgtaaattatcaggactcttcaattgaggtgagtctacagagatttcaaaagctatttgagtgttaagctatctaactagtggttggacactatttaaataatgcattaaacacaactcttgaggctctgaagaatttctgtgctttccaattcaccaggagttacaaggtcctgaaaaccacaactgtgttacatcctttaatagataaagcaaagctgattttaatgtgaatatactttatagttatttctattcctgttaatttttgtttgcttgtaatacacatttttatgtaactgggagtaaggaacatcttaggaaaaagaaaacaaaaaataaaatttcgctgtttacactgtgccttggtccagtaaccctgcactgcacatatacactttaaattggtgccttggggaaccacttcggtatttcttttttttttcttttatgttgtaaacctttcttgtaaaaataaacaaaaaacaaaaaaaagacaaacaaacacattagactatgtcaacatgaggtcaggataatcaatattactgtctgaacctccacatcttgtcccactgaaaaggcttcagagataattacactcatggagttgttatttcctatggtaatgatgcttctttctgtaatacttcctgaaagatttgcttgaggctattgtacagatttaactgtttttccataagtagaaggggtaattctaatgataaaaattgtagtatataaaacaaataaaccagtaacagagtttatcattatctaatactatgtactgcacacaattgtatgtgtactttagtatcactgaaagaagagcaaatttgtttacaccatcatcaccacaaacagtagcaatacattttgctacaatgttaggtggcttacaatatcactggatgatagaaatttttcagggccattagactcttatgaggtcaacatcatacatatatggtctgtcattgaccaaaacataattatgtggcacatgagtgtatatatcagatacatcaatcaatatattcaacatttctcccctgcttatcctaatgataaagatgatataaaatgtaatttaaaaatataagaagaaatggtgtaatggtctctatattaaaaactagagttaaattgtttaaaaaattataagtagatgctaaatacacagattgaaatacattaaatacattaagaatgtttgttctgtttcttatatattgctggttttctgtcattgaaagtttaatttagacctccttatttcatgtaatcaccccaataatttgtcttacaaacaattaacagaagttaacactatataacatagttgtatattgtcttactcttacaatgggatactttacttttcatgagggaaacagtaagctataaagtttacacaatctgagatgtagataaagattgatgtgcaagattgcttctagatatatcactttataatggtaacataaaaaaaggaaagtaatgtgtaaaatatcttctaatgcaaccctttccactcttcctgactcattggccttttttttttttttgacttctcaggaatacattaggaggctccctcatcctctggcttcaggttaggttcagcctgtggagaaccctgtaagaaggcagaaaggaagaggagaaaagggtcatggtgtttattctgttggtctcttccccatgaggctgtcttccctacatgtgtctctttacagaaggtcacttttgttctccaggtggtctgatcttctactccttctttttccatgttttgtttttatcctcactgagcgccagttccagatttattgcttacaattctttcatgctccttcctttgtatggaagcattcctcaaattattcttagttgtatttaccaactgttttctgttgaaattctgactaatccagaatataaaactttttagagtccagtcattctttgccatgttctgtttccccccatctctgtggctatgaaaacatgtatcaaatattttacctgactcgcaggaaggggaagtcccactgctttgcctgttttggataggtagcatcagttaaactaaacctttcataaactactgatacatcagtggtttcttgttacatagaatgaacagtattcaccagaataacatcctgactagcaaacacatcaattgccactcgatgttctaagtgttatgagtaaaataaaaactgaataaagattttgccctcaggatgtttatgttctcctacgtgagaaagataattaaaaatacaaaatataatatcaatttttgaatcataagtgttacgcagaaagtgaattagggtaaatttccatgcttgtagttttgcttatggtttactatttgtattcattttttaggactgtcatacaaaataccacaaactgggtagcttaaaacatcaaaagcttattctctcagttttggaggtcagaaattcaaaatcaagatgttagcaataccatgctccctctgaaacctgaaggagagaatccttctttacctcttgtcttcaggtgccagttatcaattcttggcacattttttggcaggcaactgcatcagtttgtgactctgtcatcacaggacattctccctatatgtatgtatctctgtgcccaattcttataaggacagcactcacctgacctcatcttaactagtgacatctgcaatagctctattatcaaataagttcacattttaaggtactggagtttagcacttcattgtatcttttgaacagacacaattaagctcatatgtaataaatattagtattcaaattaagtatatcctacacttaaaatatactgataaaataatttgtaatttctaaagacctcataatcatacaatcaatatttataacagatttctcttcattttgttatctataaatctgtatttttgtttttagttacaaccatgacatccccagaaagcttttctatacagagaagtggctctgaaactgttatcaacatctaaacttttgtaaaaattgaaactattgtaatttcaatttacctgaagaatgttttcttttgatgtatttgaactgagtatccctgtgattgacaggatgaaatgtttatgaaatagatcaatattgctcattgtgatattcatcattgaataattatatttttattttgtcaattctgagttatttggaaacaaaaatccacagaatgttaccttatataaatatgttaatacattcttgattattaataaatctgttactacaatgtcatatcctctcagtaataaaagcatatttaatttatgcttttatccattagaaaacagtgaagctagaaattatttaaaattttcccctaagaaatatgtggaaaaaataagaaaatttatattttaaaatgaaattgcattaagaagccaacattgatgcatttattgactaaagaccagagtttacattagggttcactctttgtattatacagttccatgggttttgctaaatgcatgatgtcatgtatccaccattacagaatcatagataataatttcactgccctaaaaattccctgtgctccacctacttatcccccacatgcccaactcctggtaatgactaaactttgcactagctctatagtttcgccttttctagaagattatatacttggactcatacaatatgtagacttttcagactggcttctttcacatagaaatatgcattcaaatttcctccatgtctaatcatgactggatggcttatttttttacccctgataattatgtcattgtatggatatagcagagtttgtttatctaattaaggaatgattacctattaaaggataagctgggtgcttctaagttttagtaagtaagaatatagctgcacatgcaataaacatttgcatgcaagtttctgtgtggtacagtataccatttctttgttcttaaatacttttcactggtgtgaaccaatgagatgctaacattgcattgctcgtacttggttggtttctaaactttacttacttttacaatttttaaagagaagtttctattgccagttttttaaagtgatatgctctgctggccttgacataacaatacaccatcattagcttttaagtccttaatatgctcaaaaaattagagagcaactatatccatgaaccaccatctagattgcaggaattaaagggagaacaaatgttcattgaatagatgcaatttaccaggacttatgctaagcattacagatctataatctctttttatatatatatatatatatatatatatatatatatacacacacacacacacacacacacacacacacacacacatatatataagaaaattaaggtgagaaagtaataaacaatgctaattagctctgtttttaaaagtaacaatccaaacttaaactcaaattatttttactgtaaaaccactgtagaaaaataaaaacaattaaattcagagttctatattgcatactaactgtaaaccacatcattgttcagattgatttttttaacagatcaaaacatatttaatccgttgcattgaatttaatgcattgtgttgctactccttattttattttgttttattttactcaattttatattttattttctttctagtagaatattagcaggtacatctgaataccagaatgtaaagaaaggaagaacagatccaaataaatatttaaagtaataatggctaagaattttccaaaattaacagcagatactgaatacagattcaagaagtgcagagaataccaagcagaataaatgtcaaaaatctatacttaggtatatattttttaaaccaaagaaaatcaaagacagagagacatactgaaaggagccaagggtaaacaagaaaacttacctgtaaataaataaggctaagaattacagttggtttttcattagatgaaagcaagaagagagtggggggaaatacttaaagtgttgaaagtgaaacacacagagacacacacaccatctacatttcttttctttttttttttttttggagactggagtgcagtggtgtaatcttggctcactgcaacccccacctcctgggcaagcaatttctcctgcctcagcctcccgagtagctaggactacaggtgcatgccatcacacctggctaattagttttgcatttttagtagagacgggatttcactgtattagccaggatggtctcaatctcctgacctcgtgatctgctcgcctcggcctcccaaagtgctgggattacaggtgtgagccatcgcatctggcctacatttctatatctaatagaattatcctgcaatagtgtagaagaaataaagaccttctcagacaaacaaaaactgagaaagtttatggtcagtagacatgccttgcaaggaatgttcaaagaagttcctagggagaagaaaaagggtataggtcagaaattggtctatataaagaaaggaagaatatcatagaaggaatgaatgaaactaaaataaaatgttttattttcttattcttaattgacctaaaagataatattttgtttaaaaggaataactgtaacaatgtattgaatgaatatagtatataaatgaatacattaaatggcagtagtgtcataaataatggtaggaattgggattacttgtatcttagtttgctcaggcttttataacaggataccatacactaggtggcttataatcaacaaaaatgcagttttcagttctgagactgggaagtccaaggtcaagccatgtgcatattaagtgtctggcaagggcttgttcatagaggatgggtcactgggatttcacacggcagaagagcaaattagctctctagggtttcttttgtaaaggcactaattctatccataacagtttgccctcatgacctaatcacttcccacagacccatctccaaatactcttaccatagggattaggtttcaacatacacattttgggggaataggggaatacaaatattgagtctgtaacactcttgtaaagtgatatttgtgttgagttattcaaagtcttatttaaaggtagattgagattagttaaaaatgtgtattgcaaactcacataaatcactaaaactgttctaaagtataactgacatgctaggagaggaaatgtaatgggattattttaagtgtcaattaaaacaatagaaataagaaaaagagtgattgttgggaggcaaagaataaatgatatgaatagaaaatagttataaacataataaataccagcccaacttttttaccacccaataattactttaaatgtgcatgatctaaatataccaatttacaagacagccattgtcagagaaaaacaaaataagacatctagttaacaatctttttctttctttatttaataaacctgaacaacattttacatctaatttaatcccagcactttgggaggcggaggcgggcagatcacgaggtcaggagatcgagaccatcctggctaacacggtgaaaccccgtctctactaaaaatacaaaaaaattagccgggcgtggtggcgggcacctgtagtcccagctactcggagaggctgagacaggagaatggcgtgaacccgggagacggaggtttcagtgagccgagatcgcgccactgcactccagcctgggcaacagagcgagactccgtctcaaaaaaaaaaaagaaaagttgatgagtaatttttgtcatatggagttcagtgatatttataataaaaattgcataccacacaactgatcaaagcacagcatatccgtgccaccgtagtcttacttatggctacctgtccagagctcactttgaaaagtcacttccctactgaaattcatgacacttatggaattgtcagaatctataaagaatgtataaggaatttttataaattatgaattactctaagtaagatattttgttaaagcagcaggaatgtcctaaaacaccatgtgatgggaacaagaaatgacatccttagtcataagcaaaacttgttgatgaaatggctaaaaaataaatatgcccaactcagcatcattaacaagggaaatctcataggtgataaggaacagaacctggccctaaggtttctaatagggccaaagtctcccacttcatgttttactcctttgggtgtctctatgcagtaaactcactagtttaggtactagggaacagttggtttagaaaggtcatgccaaaaggtcaatataaatttcttcactggccttcttttagagtaatgagacctttctgtaaaataaagatggttttgttgcatatccatacagcaacctatcatttataggagctattctttctgcaacatccatattaatacccagatgaaaagtgaaccaaaataaaaataagataaaaagatgaatgaattttttttcttaatttgggcaaaattacttcaaaatgtttacagtatatacaacatctcaaaatatgtaattggaaagaaaattttacaaactaaaaatatttacattgtgcatgttttgtttttttatttagaaataaaagccaaacaggtacccagagaagccaaatacaagataataattactttgaacactttttcattcaagcaaatttctaactgtgaatgtagggttacaagtacattccagaaagtgaaggtacattcggtctactaaatttcttggccatgattttctaaattttactgaacttggaatcacaggactggggaatattcattggggaatataaaaagtagctttctcatttttgcagtgatttcatataaaagaagaaacattatttatataaaatattttcttcacatgaaaatttggttggtatatctgtgctattttaccttttgctagatatatgttaataacttcagaaaatataatacgtgacacattttgatttatcttctgtcttcatatatcccaaagcttgatttaaaatgaagataaatcataaaacactcaatgattttgtatgttatattcaaaataaggccacattgatccaaaatcactctgtagtattcagttacttagaggagcatgttaaagttttcatacccatataggataatcaattgtaagaatttctgtcatttgcctcaatggtggtaacaatgtttatttattagtagaataaagagaatttatttccaagaaatgcaagagttttatgtattttgcatttaaaaattaagtacagttcaatgagtgttttgatttaaaaaaataaaaatgaacagaattttaaactacacttatgatgtagccatgtggccaaaatactaacaatctgacttaaaatatatcttcatctaattattccttctgtgcaaaagatgaattggatttgttgggaaggatgctttgaaagcatgaatttaattttccttcttccagggtatctatttcttccatcattgtaagtaggaattgcttactcacatgcaaaaatgcaaacactggtttttaagtgctatctggaagaaatactagaatacatatattctacatacatataatatttacaatacatattcaagatatctatagatacataaaaataaacatttaatgaaaattgaaaatattagaaaggcctaaggtacttcaggtaggtaatctcatttatttttacaggaaaaggatatttcccaataacattaaagcttatataaaatttgataattggttaagtcaagcttctaataagtggtaaataaagatttacttgttagtatccattatatgagtattagttcattctcacactgccatgaagacatacgcaagactggagactgagtaatctataaagaaaataggtttaattgactcacagttctggggaggcctcagaaaacttacaatcatggcagaatgcaagagaagcaggtaccttcttcacagggtggcaagactcaatgagtgcaaccaggggaaatgtcagatgcttataaaaccatcaaatctcaagataactcgctcactataatgagaacagcatgggggaaaccaccttcatgatctacttacttccatctggtcctgctcttgacacatgaggattatggagattacaattcaaggtgatatttgggtggggacacagagccaaaccctacagtatgtatggtatcctactatgtattgcttgaatctacacaatacagttctgtctcttcaaatggattccagctgaggatagtaaggaacaaaattgacacataatatgtagaaaataatgtatcaacaaaatgtattatataataattttcttcattaaataatattttttagtaagaattatgttaggtgctgtaggaataagagaataaaacaagtgtgtattttactctttggagaaaagtaatacaaaaaagaaagccaaaacaaagcagaatcaaagttggaccttcatatagatatgcatgtaaatatatatgcatttgtggactttcaaaaaatttaaaaacatttttattagagaaatgataaaactttatgataaaattgcattcaatttggatttagaaagggtaaaattatgtgtcttagaccattttgtgcttctaaaacagaataccatagattgagtaatttataaagaacagaaatttacttcttaccattctggtggctaggaagtccaagatcaagataccaggctctgaggtcttcttgatgcatcctcacatggtggaaggtggaaggggcaagagagaaccaactctctctgtcaagaccctttataagatcacctcatcccattcatgagagaggatctctcatggcctaaacacctcttaaaggcctgacctcttaggactatcacattggcaacacttgaattttggaggagattcattaaagccatgtcagtatccatttcttactaaaggtaaaaaataatttgaagtatgaagggaacacaaaatgaataatacctccaagaaatattcattcatttgtccactcactcactaaataaatattgagagactgacttgtaaaagctaatttactctcttctaagctccatcataccaggctgggaaactcccagtagataatatgggcactaagatccaacctaatataaactcagatcaatttacttcagatatcaggataaaaagttctgcaccattgtgagccagggttcttccagacagcagtacaaggaagtagaagagacagagttgatccaaaaagcaatgagcctgggaagtttttatagcaggtaatttcaaataaatcattttctatacaactgagattcttctattcatgaatagaaccttcttaaatgcactccagcatttctccaaagtggggcattgtaaacaaataaaaagagggccagaaatggctatttatctcacttaagtgtaatagagcatccaataccagcatccaggctgggtcaatggaaatctggttccagactttgcttttgcctttgaagataattttttttttctttaaactgtatttgaagtgagattctatatggactgctatgtaagggaagggattctttgaaaatgggtccaacccactagaagaagagataacaaatggagataagctgaaccctgattactttacttggagcctgaaatcacctttagcttaaatcatactacccttgggcttagttactttagtctactttttttttccatttatgttacttgcccccaaatgagtcttaatggggacaaatggtcattcaggtacaggcctcagaagagcattcctgatgagaggaaacatttccaaggaatgttaatgagattgttctgggacaggataaataaaagaaatacatttagaggagttctacatttaaggaacagcacagaaagagaaacgtacaaaacagctagtggtggaacagtaatagaatgaaagggaaaaccaatttctttgaaacgtttacagtcatgccccacataataatgctttggtcaatgacagactgcatttaaaatagtggtcccataagattctaatggagctgaaaaatatcttccatgtagtgacataatagccattataacttcaaagctcaatgcattactcaagtgcatttggtgatgctgatataaacaaacctatcgtgctgccaatcatagacaagaatagtgcatataattatgtacaacacataatacttgataatgataataaattactatgttactcatttatgtatatactttactatttaatgttatcttagggtatactcttatttattaaaaaaaattatctgtaagactgtctcaggcaggtccttcaggagatattttagaagaaggcattgttatcacagcagactacaggtccatgcatgttattgcccctgaagaccttccagtgggatgaggtgtgaaggtaaaacacaattatatcgatgatcctgatcgtgtgtaggcctaggctaatgtgtgtgtttgcattttactttttaacaaaaaggtgtacaaagctgaaaaaggaaaaaatcttataaaacagagctataaaagatgatatttttgtatagctgcacaatgtgtttgtgttttaagctaaatgttattataaaaaatcaaagcgttgaaacatataaaagcgttaaaatatattagattaaaaggtatagtaagataatgttaatttcatggtccttaagtgtatcatttttataaaatccacagtcatatacggtaatgtcctagggtttcacattcactcgccattcactcactgacttatccagagtaacttttagtcttcaagctccatttatggtaagttcccaatatagacgtaacattttccatcttttacgctgtacttttactatacctactctatgtttagatacgtttaaatacacaaatacttgccgttatgttacaattgcctacatgttcagtatagtcacacgctgtacaggtgtgtagcctaggagcaataggctatatctcatatagcctagatatgtagcagactatgttgtcaaggttttgtaaacatctatgatgtttgcataatgacaaaattgcctaataatgcatttctcagatcatatcagtattactgtcacatgattatacatatttaatttctactggtgaaatattattattcatattgaacagaattgaaactctagctctattacttatctctcctagttgaagccaagctttttccaacagattggaaaactatatgctactgagaaagttactgctattggagttctaaaatacatacgtatgtctcttagctctcaaaattattttgtaatatcatatgcccaaatacaaaaatataagtgcccaaatatttagacttgtatagtcaatgagtataattaagtcttgacactaagtaatattcaaagagggaagtttgctctttattttcctaattgccatgggcaaccatcagttatttatttcatttcctttcaatagttcttgctctcagcaagtcgggatctctcagagagaaagattcatagaggcctgagaaaaacagaagaatctagggacaaatgtaaaaccatcttcctaattacaatccatttattagatacaccatcctaaattttgtcctaaagaataagcagggctcatattctatttcttatattttttgagggacgatttcagtgtaagcaacaaagcagtggaaataatttcaaatgctagaatagttttttgagtaaaatctggtcctactaatgatttaagagctggaacacaacttcttgcagatctagagctggatcctagtccaagtgttcctggaagggatggggtaagggtgaatggagtgtgggaatgcagtcctgctgagtatgggcagctgttctggagccaagcaattcacagtttcactttgccaaaataaatccacttgaatgatttttttttcagggatgaaactgagaaattggtggtgagtagttctgcttaggaaaatttttgacatttcaggataaatgacaaatattacactttttctgagactatcttaaaaattcatttatatatctaattctcattattttgctaaactttctatacttgctattcacttattcacatttaaatttttattgtgacaattatataaatggaaatagctgtatcttttaagtatagaatccctatatttttcttcttgctagccatatctatcttatttatagtgagtatccacctttcatgaattctgaaagtgttcaatgacctcagaaagcaatacaattgtgtggtatacagaatattagatggtcataaccttagcctcccagtgttactttgatgattatattgtattacatggcaaaatggattgcgcagatgtaattaatgttaataatcagttgatgtgaagacaggaagattatccaagtgtacctaatctaatacaatgagctctgtaaaattttatttatttttgcccgactgtcttatttctgagagccagttttcaagctctgaggtcctttcctcaacttggtccattctgttgttaatacttgtgattgcattatgaaattcttgtggtgtgttttccaactctagccagtcaatttggttctgttttatactggctatttcaccgatcagcacctgaattattttttgtgtttgttccttagtgatatggtttggctctgtgttcccattcaaatcttatctggaactgtaatccccatgtgttgagagaggaacctggtgggaggtgattggatcatgggggtggttcccccgtgctgttctcatgatagtgagtgagttctcatgagatctgatggtttaaaagtgactgtcccccttcactctctctctcttctgccaccctgtgaagaagttacttgcttctccttcaccttcagctatgattataagttttctgaggcctccccagcaattcagaactatgagtcaattaaatctttttcctttataaattacccagtctcagaagttctttatagcagggtgataacagactaatacacttagcttccttgaattaggtttcgatgttcccctgaatttcaatgatctttgttcctatctatattctgaaatcaatttatgtcatttcagccatctcagcctagttaagaacccttgctggggaactagtgtgatctttgggaggaaagaagacatgctggtcttttgagttgccagagatcttgcataggttctttctcatctgtgtgtgtgtgtgtgtgtgggtgttcctttaattgcagtgtaaattgagtacagtcagtagacttctttccatgttttcagagtcctaaggctttgtttagggcctttatttgtagctaaattcttgtctttcttttcacagcagggtatgatagcaaagtattattggtgttgaagttttggggtgtgatctagtagctggtgctgaagtgtaatggtcactgtgtaggctcctgctcagtcatgtggctcctccgtatttcctcatgggttgcagctatgcttcctctcaatgttttgaaagtcagtgtaggctcctctcccacttgagtgctcactgcagatcttggcttggtgcatccaggctgcacaccatagttctgaaatgatcataggctttatgttacttccccagcttggaagcagcagaggagaccctgtggctcaacgtcttttcttgtcacttggggctccattgcagaaagatgcagaactgcaatcaattagcatgatcagcctgacatggggcagctgcactgtgagcccacgctggggggatcctgtctggtgactagcagagaatgtgggtaggacccgtgggagacagactggcctcctctcattagagcaactacaacttgcgggataaagcactcggagtctttgctccttccctagttcaagggtaaacagggaagttaaactggagaggcagtggcagagggacttttggttgcccctgggagctccatctctgagaaatgtggagctgctgctactgggagtgttcagccagagggtgaagcagctgcactgcttgcctgagctagaggctctgcttgttggggaacagggggtcaagggcccatagcagcaagaaatggggcttttctctaaatggtggctgtggtgtgctgtacgcatggggagaaagcaaccaacttagaaaacatatttcaggatatcatctatgaaaacttcgtcaacctctctagaaaggccaacattcaaattcaaagaatatagagaacctttacaggatgctaaaaaagaagtccatccccaagacacataatcatcagattctccaaggccaaaatgaatgaaaaagtgataaagtaagctaacgaaaaaaggcagatcacctacaaggggcaccccatcaggctaaaagcagaaatttcagcagaaatcctacaagccagaagagattgggggtctatattcaacattattaaagaaaaaaaatcttcatccaagaatttcagatggagccaaactaagcttcataagtgaaggagaaataagatcttttcaaacaaacacattcagagggaattcattaccaccagactgccttacaagagttcctgaaaggagtagtaaatatggaaaggaaagactgttatcagccactacaaaaacacctttaagtacacagaccagtgacactataaagcaaccacacaaaccagtctgcataataatcagctaagaacaggatgagaggatcaaatccacatatatcaataataactttgaatgtaaatggcctaaatgcctcaaagaaaaggcagagtggcaagctggataaagaaaaagacccaatggtatactgaatttaagagccccatcctacatgcaaggacacccataggctcaaaatgaatggatggaaaaaaaatctaccatgcgaaaggagaacataaaaaagcagaggtggcaatcctaatttcagacaaaacacactttgaaccaacaaaactcaacaaacacaaggaaggtcattacataatggtaaaaggttgaattaaacaaaaagacctaattatcctaaatatacatgcacccaacacaggagcacatagatttgtaaaacaagttcttagagacctacaaagagacttagatttctacaaaataatagtggaagacttcaacaccctactaacagtattagacagatcattaaggaagaaaattaatgaagatattcagaacttgaactcaatacttgatcaaatggacctaatagacttctacagaacgctctatccaaaaatgacaaaatatactttcttctcattaccacatgacacatactgtaaaatggaacacacaatcagacataaaccaatcttcagcaaatttaaaaaaaaaacactgaaatcatacaaacgacactctcagacaacagtgcaataaaaaatgtggcacatatacaccatggaatactatgcagccataaaaaataatgaggtcatgtcctttgtagggacatggatgaaattggaaatcgtcattctcagtaaactattgcaaggacaaaaacccaaacaccgcatgttctcactcatagatgggaattgaacaatgagaactcatggacacaggaaggggaacatcacgcactggggcctgttgtggggcagggggagggggcagggatagcattaggagatatacctaatgctaaatgacgagttaatgggtgcagcacaccagcatggcacatgtatacatatgtaactaacctgcacattgtgcacatgtaccctattattattaaagtataataataataataaaaaaacaaaaaaaaaccagtgcaataaaaacagaattcagtacaaagaaaatcactcaaaaccatacaattacatggaaattaaacaacctgctcctaagtgacttttgggtgaacaataaaattaaggaagaaatcaagacattctttgaaaataacaaaaagataaaacaagcaagaatctctgggacacagctaaagtggtattcagagggatatttgtagtcctaaatgctcacatcaaaatgatagatatcaaactaaaaacccagcattacaactagaagtaccagaggagcaaaagcaaacaaacctcaaaactagcagaagaaaagaaataacaaaaatcagagctgatatgaaggcgttcgagacataaaaaaaaaaaataaaaagatgaacaaatccaagagttggatcattgaaaaaatcaataaatagatatatggatacctagacttttaagaaaaggagaagctccaaataaatactatcagaaatgacaaagaagatgttaccactgatcccacagaaaaaaaaaataaccaccgtaaactactttaaacacctctatgtacacaaactagaaaatgtaggaaaaattgataaattcctggacacatacatccacccaagatggaagcaggaagaaattgatccttgaacagaccaataatgagcttcaaaactgaatcagtaataaatagcctaccaaaaaaaaatgccaaggactagatggattcacagctgaattctagtagatattcaaagaatagccggtacaaatcctaccgaaactattctaaaaaattgaagaagagggactcctctcaatctcattctatgagactagcatcatcctctatgagaccagcatcatcttcatacgaaaacctggcagagaaacagcaaaataaaaaataaaataaaaaaataaaaaaaaacttcagaccaatatccttgatgaacatagatgcaacaatcctcaacaaaatactagcgaacagaatgcagcaggacatcaaaaagctaattcatcatgatcaagtagaccttatcccaaagacgaaaggttggttcaatatatgcaaatcaataaatgtgattaatcatgtaaactaaagacaaaaaccacatgattatctcaatagatgcataaaaagcaaaaaccacatgattatcacaatagatgcattcaacactgctacatgttaaataaccttcaataaatttaggcattcaaatgaccacactgcccaaagcaatttacagattcaatgctattgctatagaactaccaacaacattcttcacagaactagaaaaaaactatttttaaaattcacctagccctcaaaaaagaccctggatagccaagggaatcttaagcaaaaagaacaaaactgaagccatcacattatatgacttcaaactcttctacagggccacagtaacccaagtagcataacactagtacaaaaacagacacgtagaacaatggaacagaatagagagcccagaaataatgccacacatctacagccatctaattttcaacaaaaccaacaaaaacaagcaataaagaaagaagttcccattcaataagtggtgatgggatatctgattagtcatatgcaagaagattgaaactggactccttctttataccatatataaaaatcaactcatcatgaattaaatacttaaatgtgaaacccaaaactataaaaactctggaagatatcctaggaaatgccattctggatataggaactggcaaagattccatgatgaacgtgctaaaagcaatcgcaacaaaagcaaaaactgacaaatgggatctaatgaaactaaagagtttctgcactgcaaaagaaattgtcagcagagtaaacagacaacctaaagaatgggggaaaatttttgcgaagtagccttctgaaaaaagtctagtatctagaatctataaggaacttaaaccaattaacaagccaaaaaataaaaataaaaacaaactaattaaaaagtggataaaggacatgcacagacacttttcaaaagaagacatacatgctgccaacgagcatatgtaaaaaccttaacatccactcattagataaatgcaaatcaaaaccacagcaagataccatttcacacctgtcagaatggctattattaaaaaatcagaaagcaacagattttggcaatgtggtggagaaaagggaacacttacacactgctggtgggtgtgtaaattagttcagctattgtggaacgcagtgtagtgattcctcagagaactaaaaacacaattaccatttgacccaacaccattactggatatatattcaaaagaaaacaaattgttctaccataaagatacatgcacacatatgtccattgcagcactattcaaaataacaaatacatggatcaacctaaaggcccatcaacagtatattggataaggaaaatgtggtacatatacaccacggaatatatgcagccataaaaagaatggaatcatgtcctttgcagcaagatggatggaactggagaccattattcttagcaaactaatgcgggaacagaaaaccaaagactgcatgttctcacttataagtgggagctaaataaggagaacacgtggacagaaacaaccaacaatggggcctactagaaggtggaaggcaggagagagaggatttagaaagaatacatactgggtactatgcttagtacctggatgatgaaatgttctatataccacagcctcgtgacacgagtttacctatataacaaatctgcacatgtaccactgaacctgaaataaaagttaaaagaaggaaaaaaggagtcttacctggcttgcagcccgagaagtcaaagtgatttgaatcacaagaagggttcagtgtattgttgctgcctttgaagacagaaaggggccacatgcaagaaccaaagggtgtcttctagcagcttgtgcaatcccaagtggacatccagaggaaatgtgagcctcagtgctacaatcacaagaaactgaattcttccaacaacctgaatgagcttagaggtgacttttcccctagtttccagataaaaacttaaagttagccatatcttcagtatcaccctgtgagttcctaagtaaaaaaaccggtggagtctgcctggacttttgatgtacaaaactgttagaaaataattgagtttaatgttaagtaaaaaatatgagaaatcaaacctacgtaataattttgttaatttctacaagtctttcaaatcaaataggtaggatttttaaattatatattttgttgtaaggttgtgtattattctctatataaataaattcaaattttaaactttattccaagggttggtaaaaacatatattattatattgtgaaaaatgattataatttcagttatagttctcagttgtggttttatattttctttcgtatttttcttgcgtgttttctgtgtggttttcaagtgtttttaaagttttcctccatcctggattttctttctctcaatccatgtatcctccaactttttcaaatatccccatcaaattgcctccctctccacttactaatatactcctttcaacttttcagttgtttcacacttttgtttttagttcatattttagtgttttagtttatttatattttatcttcctaaataaaaaagttcttcctggagcatttattgacattctcaaaggatgaaccacttctatagagcttaaccaacacatttacttacagttatattcccatattatcaaaactttatactactctaaacttctttttctgtaagcaaaagccaattggtaactataatttgaattttcatgtaaaatgacttgtacaattgttttgtgcaaatgttattttcctttttcgtgttgaacaatgggaccaaaacataaaaacaaccaaatggcaaacatttctttgacatatttactctgtaagtgggctataaagaggtctcataaaattattttttctttaaaaaaatccttcttttctgtatcttccatttgatattaaaatataacattaagctacttttttttttttagatgaaatctcactctgtatccaggctggggtgcagtggcacaatctcggctcactgcaacctcagactccactccctagttcaagtgattctcctgcttcagcctccacagtagtggggattacaggctcgtgccaccgtgcccgactaatttttgtattttgagttgggatggggtttcaccatgttggccaggctggtctcgaactcccaacctcgtgatatgcccgccttggcctcccaaagtgctgggattacaggcgtgagccatcgcgaccggccttgtgcctgttttacctgttattgcttacattctgttctctttactatttaattctattccatttacatagactcaatgcctaaattttatttaactttgaatcataattttctttaattatcctaaattttctctgctttccttcttgacttattccttctggtacttcatttcaattactaaaatttacttggttggttattgttaaccgaacttctaattcaatataaagtagttcaaaattatgagtctttatttttcaaaaggttttcttttccagtcatcatctagtaatatgtgattttaaaatttcattaaatttagtctatcttttaattatcttggtttaatgaaggattgttttagatatatgtatttcttcctcaatttccttccttgatactactgcattgctttgtgcatgtgcccagctgtatttcttggtatataattttttgagaagtgtgatgtagtaacacttctacacttctacatatttcttttacttctagtaaaagaaataatattcatgaaaggattttagaaaaactttaaaaataggtaatttaaatagaggtttcagcagcatgctgatgctcctcagtaagaactagatggcatacataaagtcaaaagaggtttgactttgacttcaaaaacaattcaactagatagaaaggaaataataggtaatttaaaaattactatagccatcccacctaaattgaaatgcagaaatatgtagaattagaaagtaaagtatttatcaaaatataacggttgatccaaattattgcttttcttgtcagaaatattcaggaactaggaaataatagtcattactttcccaagtcagttattctttatgttcataagtaattgcttatttgctatagccaatactcatggaagcctttgtcttctgtgacatagcaggtttacagttctgcttcaaatttttgaagttttcactgttacattcactggctcattttatttcatgattttgagtctgggagacattcccttggctcagtgttttcatctattgtaaattcacttcactcacaatttgcaccttttcttcatttttcattataataaataacagtttctttggtttggaaatctacagtcaaccttaagtttacattcatattattttaatttgtctctatttcattcctgctctcataacccttacctaatcaatgtctaaattgtgaagaataagcattgtagtgacaaatgtcatgcttgtctacatttctttagacaatatctttttatttatttttctttctttttttttttttttgagatggagtctcgctctattgcccaggttggagtgcagtggcgcgatcttggctcactgtaagctctgctaggtgcagtggctcacgcctgtaatcccagcactttgggaagctgaggcgggtggatcacgaggtcaggagatcgagaccgtcctggctaacacggtgaaaccccatctctactaaaaatacaaaaaattagccgggcgtggtggcaggcacctgtagtcccagctactcaggaggctgaggcaggagaatcgacaatatctttttaaaacataattatttgattcctgaattgccaaatcccagtctgttttttagtccttttcttattgctttctaaggcataataaatgtaactactgggagaaatgtatcaatgtcatctttgaaaatttttaactatctaaatttggtgaaatgataagatatggatatatgtattaaaatattcgcttgagcaatgactcagtacttcagaaacaagtagcaggctttaaaacctgaggaaaaattaggcttgtgtcacaacacaaaccacaagaaatccaaaaacagtaagggtgactgtgcaaggaggacagaaaagaagtactaaaccactttaacactatcttacatttatcagaaataacagaaattatacatatatgctctacagaattttaaacaaagaaacaaaatgtggtgcttttctccagatgttttggccagaggacataatctgaatgatttaaattccttgaaattgactgtgacttgctatacagccagcatatggttgttttattttgtaaaatatcctatatgctcttgaaaataatgtgccttctgtttctaagccaattcggttaagtcaaaacaaaattctaactataagataataataaccgagaataaatagtcacctgcagaggaccaaagcattctatcaaacttttactgcaactggattgcaagaaggtaatggcatattaaaaaagaacccagaaataaacccaaatacctaacagccaactgatctttgactaagcaaacaataacacaaagtggggaaaagacaccctattcaacaaattgtgctggaatagttggctagctacacgtaggaaatgaaacgggatcctcgtctctcaccttctgcaaaaatcaactcaaaatggattaagaaattaaatctggctgggcgctgtggctcacgcctgtaatctcagcacttcgggaggctgagacatgcagatcacctaaggtcaagagttcaagacctgcctggccaacatggcaaaaccccatctctactaaaaaaatacagaagtaaaccaggtgtggtggcatgtgcctgtaatcccagcttgggaggctgaggcaggagactcgcttgaacccaggaggcagaggttacagtgagctgagattgcaccactgcactccagcctggggctacagcaagactctaagactctatctcaaaaataaataaacaaataaataaatgaatctaagacctgaaactgtaaaaattgtagaagataacattggaaacacacttctagacattggcttaggcaaggatttcatgacaagaacccaaaagcaaatgcaataaaaacaaagataaataggtgggaaataatgaaactaaaaagcctttgcaaggctgaaggaatggtcagcagtgtaaacaggcaacccacagagtgagagaaaatcttcacaatctatacatctgacaaaagactaatatccaaaacctacaaggaactcaaagaaatcagtaagaaaaaaaacaatctcatcaaaagtgaactaaggacatgaatagacaattctccaaagaagatatacataatggccaataaacatatgaaaaaatgctcaacatcactaatgatcagggaaatgcaaatcaaaaccacaatgcgataccaccttactcctgcaaaaatagccctaagcaaaaaatcaaaaaacagcagatgttgacatggatgcggtgatcaaggaacacttctacagtgctggtgagaatgtaaactagtacagccactatggaaaacaatgcggaaattccttaaagaactaaaagtagaactaccgtttgatccagaaatcctactcctggatatctacccagaggaaaataagtcattacaggaaaaagatacttgcacatgcgtgtttatagcagcgcaattcgcaattacaaaaacctggaacctacccaaatgaccataaatcaacaagtggataaagacactgtggtgtgtgtgtgtgtgtatacacacacgatagaatattactcagccataaaaaggaatgaattcatggcatttgcagcaacctggatgagattggagactattattctaagtgaagtaactcaggaatggaaaatcaaacattgtatgttttcactcataaatgggagctaagctatgaggatgaaaatgcataagaattatacaatggactttagggactcaaggggaaaaggtgggaagggggtgagggataaaagactacaaatagggtgcagcgtatactgctcgggtgatgggtgcaccaaaatctcacaaatcaccactaaagaacttactcatgtaatcaaacaccatctgttccccaataacctatggaaatatattttataaaaaaattatagaaggaaaacagctataatgtagaattttatatccaaatgaaatgctgttgaacattgagagcattttaaaaaatattcccagactcatcctccctcaagtggtttgctacccaaagcagggtactaaaaacatttttagagaaattattcaaacaagaaattcaaatatagatgatatgtcaagaactatcagatgtacaaatcatctgatgtcataataaaatttactgttattcattaattttcttttaaataaacgttttattgttgtttcacacccctaaaaaatatacaaatcataaacatagatctcaatgggtatatcataataaacattcaatggatattataaaattaaaaaaagtaagctactattttgcaataaacataaataaccatgcaggttagggaattagctattactgacaacccagaattctcctaaactcattcctaggataatacttgcctaccttttccaggtaactaatgtcccgactttcaacaattttctcataatgctttctgggttttcattttcagattttgtattctagttagtaaattaattcctgtataattgatgtttctgatgttattgttagaggtatcttttttttcaaatttcaattttagaagttcttctttccttaaaaaagaaatgcaattgatttcaaatattatcttataggcacataccttgtaaatgtattcatataagagtttatctgtaaattgttcatttttttggtgaaaaattatcttaattacttctcctcaagttcttatatcttttttatttcttctttactttctcactagcaattttgtcaggtgtaaggttgaacaaagttgatcatagtcagtatcattttctcattcccaatgtcagtaggaaaatgttcaacactttgccattaaagaggtgctcatcacagtcattttggaggtagcctttaataatttaaatattttttcatcattgcaacttaggtaataggctttgtcactcatagactttggagttttttttttttagttatagagaatgtcatatgatttttggcttttattctgttaagaaaaacacactgcagttttaaaattttgaatattaaaacacgttcattcctgtaacaagcccaacctatgtttgtggtttacatattgcggagttttatgtataatatttaaattatttttagctaggttgtaagagagactggactgttactgtcttttcttctaatgtccttgtcacatttctatgttaaaattatcggtaaccttataaaacaagctgagaaatttttcaataggggaaatatgtaagtaatgttagttttctttcctgttaatatgttttggagaattctctagtgaaacatctggacctagaacttttgtacatatatgagaaaaagttatttattatggattttaaaaatagttacaggaatattccgatttttatgtcttctcatgtcagttttggtaagtgactttttcaagttttttacaaattttattgaaactgtcaaatatgtactgcaataatgtagctcataactttgaatttctttcttctgtaggatcagtagtaataccttttctttttatattactgtgctccctccctccctctctctctctctcacacttttttttggtctctgaattttgtaaaagattattttaacattattacaaggaaaaacttttggcttttttttgatccccttgattatgtgattctttttgaatgtattattttccattaatatctcttgtatgacttctattttcattggatttggtttactgtttggttttcagcttctttaaatgtaccatttttaagcatgttctattttcaacctgtgggtatttggactactggcatttaatcttttattctttgcaatatcaccattaaggctatagtttttttaaaaaaatcaatagctttagggctaaagggtttttggttacatggtttattgtattgtggtgaagtctgggcttttaatatagtcatcacctgaatagtgtaccctgtacccactaggcaagtttccatccctcactcctctgtcaccctccccgctctgagtctccaatgaccattttaccatctgtatgactttgtgtaaccaaggatatccattttcttgagtttcaatatgtcatacatttattctcattttctttctttttctttcttttttttttcttttgaagacggagtttcactccgtcccccaggctggagtgcagtggcgcgatctcggctcactgcaagctccgcccccctgggttcacgccattctcctgcctcagcttcccgagtagctgggactacaagcgcccgccaccacgcccagctaattttttgtatttttagtagagacggggtttcaccgtgttcgccaggatggtctcgatctgctgacctcgtgatcacccgcctcggcctcccaaagtgctgggattacaggcgtgagccaccgcgcccggcttattctcattttcttaaaatattttctaatttccattgagactaattttgtgacttgtgaattatttaggaatatgttgcttgattttaaaatatttgtggattaagttgtccttttgtaaatgatttctaacagtttaactgatgtcagaaaatgtattatttctattttcaattatgaaaatttgtcacggcttgatctatgacacaatatagagcatttgaataaatattaaatgtgcattcacattacatattcaattttaagtttatcgagtttaatattatgctatatatatcaattagatcaaatttgctaatagagatatctaattctttattattcttaattacatttttttctacttcttccaaccgtgtaagaaaagtgggcaaaagtccccagtatgatatggatgcattatatttctcccattattacattaatacaaattttaaattgtcacatcatggtatactgctcattttatcattttgaaaggtattcttttgtcttagtactgcttcttgccactaaatttatttcatctgatgttagtacatctatctcagctttcttttggttatgtcagcctaacagaccatttttacatttttttttcagacttcctcagttcttatttttaataaaacacattcaattacttttaaaattcattttagatatttttattagccgaagtatgaaaatcatttatatttagctcaagatattttgattgtggtctaccactttgctatttttccatctgttgtattttcgacttgctctttcttgccttttttctcaattaagcatttttttctccaatatgcccttataatctcctataagtttaagtatcttttgattttgccctagatattatttcatgattccttgacttattagtgtctgagtataaagtaaaattttcattacttttcttagactatgaagatcttataatacttttgatattttgttaggtagttttgttgatatttattttaaattttatatgatggattttatttatatagtcactatttatttagatttatccagatgttttgtcctttcttttcttgatttcatttctaaatttctacatttacatgtaaaataatttttcttctgcttgaaagacattattatttcatttggtgtaatgtataaatgatatagatagttcccttattttttgttttcctgaacatgaatttatttttttctcatattccataatattttattaggaataaaattctagttaccagctggcttccatttgagaagtcatccctaagtcatattgccactttttgaaggtaatatgctttttcctagaactatttttgagatagtctctttgtcgttaattctctaatatgagctatgtagttgtctccatatttatcatgcttcactctggcacttcctgagactgtgacttacagtttttccatctttttttttattttttatttatttatttttttttgagagagtctcactcttgttgcccaggctggagtgcagtggcacgatctcggctcactgcaacctctgcctcctgggttcaagcaattctcccacctcaacccccaagtagctgagattacaggtgcccaccactacgctcagctgatttttgtattttagtagagacggggtttcaccatgttggtcaggctggtctggaactcctgacctcaggcgatccgcccacctcagcctcccaaagtgctgggattacaggcatgagccaccatgcctggcttccaacatttttgaaaaatgttaagtttacctatttaaatgtggcttttgcccttaatatttctaatattctaatgaaattgcagccaatagttaattctggttaactctaactctgttttttggagggttatctaaggtgtgttacagttcatattcatataatcagtgattaagctggtttgagaccaaactgcaattattgtgaattataatctatttatttccattaatattcctaaacctttgaagtgtcaaatgaagcctggggtgtataaatcggcctttctcattgataagtcttgagccatatattttattctcttaaaactataagactatgaatatttctgcttaggtttttcgtctatcaatagccacatacatgtgagaaaatctttcatgggtcaagggatagtccatattgttctcaattctctgaagtgctgttttcttcggtattttagccctgtaatctttaatgccttggaatatttttgatacctccatgcatattttatacaattttcataagaagagagttgagtagagagtcagtttatagtttagagaaaagagaaaaacaaggaaaaaaataaagagaatgcaaattttaaaacaaaagcaattcagaattgaaattatagaaattatctatataatgagaaagatgaaattgaaatctaagaaacatatgactatgacaaagcaaatgtatctttagatacaatatacagatatcaatagtttaagaaagtaatatttattttcttatttaaaatgttaagttaattaccacagagataaatttaaatacttgttaaactaatatagtgagctattctatagacaaacaatagaagaaatggggaaaggaaacaaactaaaaatgtgagtaaatgtataatatgatgtaaattggccgaactaagttaaatgtaacaataatgacaataaatgcaaataagttaaaagcagtaattaaaggatcctgacttttataaattttttaataagagccaaaacatgttgttgacataagttaaaatttaaaagaaaatatatatgtatataactactaacattaaaattattttataacacaccaggcttaaatactaaaaagctagaggggcaatatttacatgacaacatgacataatataatttaaggtaaaaatatgtacattgaaatacatttattattaaagattaaaattatacgagctctatttttcaattaaaaattggagaaagagcagtggaggaaacccaatagaaatagttaatgaacaaaaatctttaaagcaacaacaaagaatgttaatctaaccaaaagttagtttttgagaaaacatttaggatacagaaacctgtggaaggttaaccaagacaataagagagactgtgtaatatgcacaattaaaaaattttaagtattaaaatagcttcattgtaataaatgtgaatgctagagatggaaagatgtaaggactgtaacaactaagacgtattaataataggaactaaagataaagaatataggattttacaggaagtatctaacaatcatttcaatatttatttcttagtctattaaagatcattccttcaaatcctcagataagtaaattctatcagaattttaagaatctgttatttattatgctacttctgaatatggaaaaacaaattgcctagctaaggctagcatatgttttattccaaaatcaagtaggtagcagtaattactcttaaaataatatttatgccagcaaaagagcacatcattttgtccgacaatttgtatgagacagcaaactgttttagtcaggggtttgagctagatatagattttatcgtgattatcattaccttcagtccacacaggcttcaaattcctataggaatggctgatgttggctgggtttaaggtgggtcctggggtgctggaggattttgtttagtacctctgttcccctctcagctttcagcatccttaccttcctgcaccgccgaggtgttctctgtctttcctctttcccttactcaatacgtagacagctgatgcttattatttggtatcaggcttggcataggggtaaaaagtggggtgttttatgttgccctgtctcagcctcattcaatcttaggtatgtcctgtgtgaaaaaagtccaagttttcattcctttttgtctttttgttatgttggttttagactactgtcattgaattaagctgaattttttttttttctcaaaatggggcattcttagtgttcttgcattgtgtccaactcatctatgacaatgaaactctgtcttggatctgtggttggttttgggtggaaatatttaccactctatagtagttaaaggcttcttcttgttattggtatagaatcttagccacaactgtttcctagcactcttccaaagatataggatgcattcttccacttgttcccaagcctcagtgcatctttgcctgtgattagtggaaatgacagttgtgctgtctcttctatagtggcttaaagctttgcttcctaagaaagaatgttctggggtagtgggcaaggctttttgccagtcccccagcagcaactgattattacccgaagcctgcactatgcagcagggtctctctcatcttctgcccagttcccagtctttcccttcaacagacaaagttccgtgtaaaagagtttaagaaatgaccatttcttgtgcctgaggcctcctgctattctaaacttacaatttacccacatttagcctttaagaatttattaaagtttagctgatttcttatatgattatatggtgacttcctcttcattttttgattggtcaaagatgaaactcattttgtgtcctttccatccttgagggcttgtccctctctggaatcagtttacttggttgccatgcaacttcatctctgatgggctgaaaacaacttatgactttgtagataattcaaatatttctcaccttaagggtgggagcatcattcttttcacctttctacatcctaatcagaagctgaaaatcacactgaggttttagaaattactcttccaagatgcaaaatattaagaatttccattttaaatcttagcagaaaaaaattactctagttggagtttcaccaaataatcttgtaaaatttgaagttttcttgagagacacctgccttcatctggtgtgaattatgaaaaccttagttacacttggaagagtaaatccttacaaatcaatatatttaacattggtaaacagacaagcaataaaaataaattataaagaaacaacaaaaataaatcatttagatatctaacatgatatatatgaggatttatcaaattttacctcatggtttaataatttcttcaaattaaagagaataccttaacactaatctgcctttaacaaataaaatttattgcttatagttcatacatgttgtcttattaatgcattagaaaaaaccttttagtataattttaaaaattatttaaaaaatatttaagtatgtttcaacagaattggtaccttttataatactgtgctttcctttatgcattttcaaaattgtgttgaattagaaatcaataaaattaaaaccaaaaaataaatagaaaaaaactgatgaaagaaaaaagctagttatttgaaaacatcaataatattgataaacttctatcaagattaactaaaacaaacagagatgacataaattattaataccagaaatgaaagagaggacatcattagtgatcccatgtacattaaaggatagtaaaggaatattatgaacaactttatgcacaaaaatttaatgacgagggtgaaatgtaccaattccttgaaggacacaatcaaccaaaactcacatgaggagaaatagataatctgaacaggcctttatctattaaagaaactgaattaataattaataccctgctaaatagaaagcaccagggctagataagttcactgctaaatcttaccaaacatttaatcaggaaattatatcgattctgcacaatcacttccaataataaaagtaaaaacaagttattctggaaagagggaccatggcacaagaaatgtttggcacagcacaaccagtccccagagaccaaagctaggccatatcttcaaagcccagagtgtgcatagcctgagtcaagctgaaggaaggaataaaaaaaaaatggggagaaagtcagggaatatatgatgaagcaaaatcttcatgtctgatgttctcagaatgaataaaattataaaatgcaaagtgcatatatcacagtttcagaagcaatattggtccaactgctgattttctaaaatggagaacagatcaacctctacacaaactgatagtgaggcagaatatcctggtcttcttattgtaagagaagaaaacgtctttcatggaagtaacagtgaaagaatccgttatcagaacataggacagaacgtttaggggtattttccctgcaggcactaattagatatatatcataagagctatgagcacacaggtttactatcagtgaggctgaagcagtgtaatttctgggaattataggcatgacacacatttgtgacaaataaaagacaatacagattaaactgctagatctaatgtcaacctgttttttgtagaaagcctagggataactgcccaaggtaaatttttacaatatgagcacctagtatttccagggacttctttactcctttccacattgcttttttgatgtatgacactttgattttgtctccgatacaatgaccacagcataaagaattagtgccagtaaagttagattataaaatcaaaaatttgactaagaccataggaaataaatcaatagaattacaagatgtagattttaaaattacttggtaagaacttgcttaactcaaaatacaagtacaaaatgatatatcagacaggagtcagacaggggagcaaagttagtaatgtgttttatgggataaaggacttattaaaggaattagatgtgtagagctgtacaagtagctgggaaactcaaggtctgaaagggaagttcaagaatcagaggacctctcactaacaagtcaatatgaaataccaaacatatctctttatgtaagggttgctcctgggatgccctttgagaggctgtgattttgtgtagctacaacctctgttgattcacatctaagaatcttttggtgagtcttgggctgctgttgatggacagaggcaacagtaggcaaaggtgttgaacgtggaatagagcagatttaggacaggttgcaagccggctggaacctctgcattgatccgatactgcatttgattatgatgaccttcagagaataagggccaccaccttacttcctttttcctagttacgtacaagttcctcttttggataatacagagaaggacatcttgaaaaaaaatgtacttttttgcctactcaagatgacacaatgcaaaacaccacaaataattaccagaattgaggaaaataagaattttctttctcatgaaaagtttagttgggaaaggtgttctagaatagccacattggatgggagggtagcaatgtttctccactcaggtgaggggagagtatttataaagctcgatgaatatctccaaaatttaggagtggcacaggagtctgatgtttaattaattattttccagaattagagtaaaagacaaaggctgataagctgttttgctggtaaattaaagaacagctgctaatacatttagattgtcaatttcatgggtttgtgaccactgtagttgtataagaacccacattcagtggatccttcaaaactttactgttactgtcttgaaatccttaataattttatctttgaatttgtgttttgtaagtgaactctgatgggacaatggagcatgagccaggagcatggggcctcagctcacatgtgatctcaccttttgccatcttgctcccccactgatacctagagaccactacaccacctcttacccagcaggggtctgaggccaaatacaaggagactcagggtcatatcctgagtaattttgagcgctctgtgagcatccctgtttccaaggcagagtgaaattaagagcaaagaaaaaacatcatgacaggtcaagaaagaaaccacaggaaaaaaaattctattatattttcttttgtttgtaaaagggatcctgcaaattaagtagctgacctggggtttcactttctggatttcagggcccacgaatgcattaccttttaacccagatcggaaatgatccacatgagcaatgaaagatggcagatggcttgaagccaagtgtgctttaagaacacttgggtgggattccattgcatggaatgaacttctagaacaggggtgttcaatcgtttagcttctctgggccacactgcaagaagacgaattgtcttgggccacatataaaatgcactaacactaacgatagctgacaagctaaagaaaaataaaatcaccaaaaaaaatcccataatgttttttaaaagtttaccaatttctattgggcctcattcaaagctgtcctggactgtgtgtggcctttgggctgtgggttggacaagcttattctagaaagtgaaaagtttcatgggaattgacagttgtagattaaatgatcacttactatcagttaagaaagaaatttctctcttcattaccactcctatttccagacttcagtcctagagtggtcagtagaagcagttatccaataggagagggggtaagtaaggtgaaaactgctgaaaaggaaaagaaaccaagaatgaccccttcccacagcctacagatgaaagaggtaggggagaaaacatatctgaattatattttaattaaaatatagaaattcatattataatttctgaaataaaattgtagtttacaacataatataactatctgttaaataccaataaccaaaagaagtcatgaaagctgctagatttttttacagatctggaaacttttcctgaatacatatttaaagaactacagaagacaaaaatgaaattgcattgaatgacaattagagacaagtttgttctttcgaaaaaattggatatttgctttgtaattttcaccaattttattttcctgaattatttctatttttaatgtagaaacaaaagtatctgagatgggtctaagatatcagagaattatctgtatttgtattgagatatatcaaaatataatgttaatatgatttgtcactgaactatatgataactcagtcgtacttctgtcttttaaaattggctacagttaaacttcaatctgtcaataaagtaaaagctaccaaagtgggaattctaaaattataacatgtgataaaatctcaggcagaagttttggattctgttgtttttattttctgccatttgtgccgatttgagcggtaactgacctcatgaaacatggaagtattatttatgtacaaggaactgacccctgagaaattgaaggtcagcactaaaataaaaatgtagggggaaatgcaactaataaaatgtaggaaaaaaatgtgaacagaaaatataataaacctacatggtggtgcttacgtagataaaactgaaagaggattgtaaatagaactgtaagaatggatttgtctaccatttattatattttgttaaaaataaagaaattcaatttacaatattgaattttactagactttctggtttgaaaagctagagtttctttttcctttcagaaggcttgtattcaggtaatactgatgaagagaatcctcaagacctttacactctgggtcagttccaagatggctgagagctgtttaaaacaaccaaaaaacaacttgataggattgacaatttcatgttttttaataagtgttgaatgagactgctaactacaatcagcagatatacatatgtggtgtcatagatgttaggttttcaaaaataaagaatgtgttagaaaaatgcctgcaaatcattcgaatgttacaaccttttaaaaaaaatctggctgttgagtgcagactgtgctgtttcaccttttattacaaagactcagtgaatgaaacatatttgatagcttggcaatagaagaaaaatttgtatttaaatgaggacagaagacactgggctggaattgatatgattatgccacaattgatgagtcataactaatgacaaagtctagagctcaggaagcaaatctgacaacgggagtgagaggaatgcaatcagcacactgggaggaaggcaggtgcatgcccacaggtcgtgccacagaggggtacttagcacaacacttgctcctcattgtgtatctcttggtttctaagcaaaggtctttggggagaaaagatgttattaaatactataaaactgaaacaaaaataaaattgagcctagctaggcacttgaaaatatactagtctgtgacacagtaaaagaaaaatcatgtggataggcaacagatagttttggaaatttaaaactcaggttttgttttatgtcttcatatatgatgctgaggtaacagatataaaattaggaatttgtcagcaatagctcctcctgcctttatcatatgttttaaatgatttaacagtgacattttattgtattttcttttttattgagattcatttcctatcttgtctaatattctcctattctcctgatagtttacacacaattatcacaaaacactagcagttccactaattttgtcttcactatcctcagagactttctgaggaaataataatattgtttcttttatctttatctctggagcttagtagggtaccttgcccattgtagttgagaaatgataaataggaatgactgaaaaaaaatacatttgaaaacagcttgaacataagaagaagcttgagatatttataatatggacacttgtttttttcctaaagcaaagctattactattagttagagattatgtagattttaatttctttatagaagacaaaataaaactagtagattaaaaaagttagttcctgccactattcttcccccaacaagatatctggggactgagtgccagaatgagcaaagaaagattcaaggaccaagactggtggaatcctctcactccagtattcttagagtcttgcttaggcttgaagcataacactgttgtcacatcacttgacaatgcatttacggaataagattcagtgagaaagaacaaacaagaagtgattatatcctttaaagagctttctcagaggcatcggctagtatcttgtttgcttctcatttgccagagttgcatcaagtagcttctcccaactgctcaggaaattgggaagtatagttttctcaacattttcataccaccacaaacactcccaagaatgttcataagcagtctgtaatacacaggacacgtcccaatgaccaagaattatctggtctgaaatatcaatagtggtgaggttgacaaaacttcctctgaagcacccggcattgggataaggtctcaaaggaaacgttaaaagacaatgcaaaatgaagaagaatatggggtaccaaaattatagttatcaatcaaccacagaacttagttttccccaaatatctgaaaggttgtttgacttgtcaaaatggaaacaatgtattcagtactgcttcagaaggcaaacctaaaccaaagtttgaaatctgtgatgatgaacatattaaaattatagaatcatttgaaggttattattatccagcagtaacacagtagatgcctttacagaactgaatgtaatgagagactagtattgtgtccctttgtgaagtctttaaattataacagtttcaaaatatatgaagattttgaccaaatcagaacaaaggccattcatgatataaaccactttgagacagtaagagctattggttgggtctatagggccactagtctaggcctccgataatttatgcaccaggagaaatgtctttgaggaacagataattgcctgcatgcctctcctagacatgttggtggaagctgcaacaggagtggttattattaatcccttttagaggacaatactagtctcacctctgaaccacccatcaatattgtgctcaattagcactttgtttcaattgacaatgaaattatatactgaaaacagcatgaatccatgacctgaccagaagcattctctagccagtgaatgatttttctatccttgcctccttttcaatttaacaaaagaggataacactgaattcagactacaggtgtgcagatcctcattgttttaagtcatcagaaagaacagaattaaaaattaatttaaaaactaggaatatttatatcgtctttcctcatagttttcctcttctggtcttttgccttaatagttatttactatttctcattcatatttggtagaaagtgtcattatacaatgtataacaaaggtcttgagaatacaaatgtataactctttcatataattataatccaaagaaatctttaatatattcatgttaaacatcagtttatatgatatttgcaatccatgtgaaaaaaccattttacaaaaacattaaaataaagcccaagtttttgtatttgagtgattcagcttaagaagacttatataatttacgaaataaatacatatcatttgagcataatgcaacacacctttaaaaaccacttgtttgaaaagaagcaaggcatatccactgattatatacaactactgctttcaaaattttcacttttaaccagtagacttttcatcagtgttttatattgtcagggtgttttttgtttttgtttttatgatttaatgtatttaacttgtttctctattagaacagaaaaaacacatacttctttatttcttctgcattcctttccatttgttggccatgacagcagttagattatacccctttctactgaagcgttgtgctaagttttgggagggcaggagaaaatatcttcagcttgaaaaaaaaaatacttgaataaacaggtaatttttttattaagatatacaatggtcactttctttagtgagttatgacaatctacctctgaagtacaacatgttagagtcatttgctctggacaaagtcactttcaggaatggttttattacaatgaaaaggaataggtatactggctcttaagtgccactattgccctttatgagaatgagaactagattagctggcacgcttatatcccacactctttatgagccttatatgttttggggtattttcatcattttaatctggatgatgttattttcagaaacatcctaaaacaattttcaaagaagcaaggaaaaggttaacactgaacttgcataatattcagtcatgaaaatgcatttgaatacatttgtttagcaatgctaacatagcaatcttcagaagttgcccagagatatcttttgaggtttcatattatgttaaacatgcaaaagcataaaaacagggaaaaaggaaatggtataacaataaaaaggtttaaaatgatgaggaatattcatttgcttccctgattaaaattaagttttataattatatggataccaatatattagaattgttatatacaatctaatttaaggcataagagataagtgtgttcaaggggagtagcgaaaaaagtgctcttaatttttctttttgattttttgctgtggttagtgttaatacatgtatattgaatggatatcttatttttaaacaacaaaaccttatttcaacaacaccaatctacatatacctgatattttatataatgcactaatgaaagcattgtgatgttaaaattagcattgtagaaaggaaattgataaatgtaactagcaaatattaattttgggggatgaatattttctaatctatttctgaaaaactattacttggttatactaatttatttgagggtaccttcccctgtatcatttttacctccacttttgaaagaagcaaacaatactccttctgaaaaataaattttaattctacagctttctatgacaacttttttgttattcataccaaagatgaagctatgcccataccttattgattatatatgcaaagagttctctatcaggaaagtttcaacatgaaagatttcttcccactgaggagtctctccattacagaaggtcaactggtaaatgttattctgtttccactaataaccatttgatcctcttttagattttcattcactctagtgttaaatgaatctttgctgaaaattattaaatcaaaactataataccttaatagagaaaaatgaatgttatgaggcagtatctcaccatcaaagttgcagagacatgtcttttcaaagtgaaatatatagcttatctagttaacaaaagggcagcaaattcctttgcaggtctaaaattgagccagcaaagtggtggtttacaaacagatgccagtttcaattttcatgttagatgatcaaatatatattgagtctgcataggaaatgctgttatcacaggattcaacacacaatgtcgaattcctacatagagaaatttcattttttcattacattctgtacatgcaaacttcctagctagtgtggagaaaacctaggaaaaaaaaaagtttaaggtgaaccttgaaggatgagaatgaatgaagtacagacgattatgtaaggtttgaaggcatgacactgtatacaattactgagtaaggatggaacacatccacactagtgatgagaacaaatttatattttcagtgcagtacatccattcattcttgattccttcttagacattatttcctaaaattgagccacaggatggtcagaatggtcagatctgctaccacagggaactgggacttttgtttaataatacatactccacaaacatgcacaacctcttctcctcttttcccccagagtagctgattctactacagtgattcatatgacctggatgggtaaaggggtatatgcaatcaactgagttcattagaataagttttaaagtgttaaagaaatgatgaggctgggcgtggtggctcacgcctgtaataccagcagttcgggaggccgaggcgggaggatcaggaggtcaggagatcgagaccatcctggccaacatggtaaaaccctgtctctactaaaaatacaaaaaaaattagccaggcgtggtggcaggtgcctgtaatcccagctactccggaggctgagacaggagaatcgcttgaatctgggagtgtcggaggttgcagtgagtcaagatcgccacggcactgcagcctggcaacagaacgagaccccgtctcaaaaaaaaagaaaaaaaagaaatgatgactccctgtaacaattgcctggtgactatattcaacttagatcaaaacaatgcaaaaaatctactgtaaactgtgccatttctgtatcaggattttaccaagttagcacaggagtaatttatattttgagtttaaactttagagcagagcttttaaatggaaaattctgtgacaataaaaatttctataatatactgaaaccttggaacaagaattaaaggcatacaatggtatatttatggaacttttattttattttgattaatttaaatacaaatgtaaataacctcatgcgtctattggctaccatattggatagcacaactgtacagcatcagtaagatttaaactcatacgagtattatcaaatctactaaaaatagataagactttttcctatcttaaaatagaactaaggtgacattttttttccacagccatattaatggatagcaaccttttcaatactgtttcctcataagtgtatggataaacggattccaaatatatttggttaaaagcaaggcaaacaaatatattgaattcagataaggactctaggtcagagatcaatcgaaagtgggtcctgatttcaagactacattattttgtgctgagtgaaacaaatgaaagctaactaaagtaagtataaatgaaataagatttgtaatataggtaaagcaaagtgccctaggagagcaggaatatttctttccattgtcagatataagcatgatatttgtggtgggccttgaaagactagaagaataagagatgtaaacaacaagacttaaaggcataaaatggtatattatatttatggacacttggagttctcactattaagtgggaggtattgataagaacacatggacatgtagatgggaacaacacacaaaccagggccttctggagtgcagaagttgggaggagggagaggatcaggaaaaataattaatgagtattaggcttaacaactgggtgatgaaataatctgtacaacacatccccatgacacaagtgtacctatgtaacaaatctgcacctttatcccttaacttaaaagttatatatatattaaaaaaaaacagtgaagtttgaagtgatgctaaaagagcaatctggcaataggacatgaaaggtcatgatgctatgtctggaaatctgaaacttactctgtggatgatagagccaaaaatattttaagtataacaacatgatttgatctctgcattaggaagatagccgtatggcaatatctggggatgactgcaaaggtaagaaattacaggcaaggaaaccagtgaagaagttactagctataattcaagaatgataaatacttgaatcaggctagtattttagaaggtatgcaaagtaaaggctatctttctgggccattgcaaagttgggaggtgattactgaataaaccaagcatcttcgggagaggagacaaaaacagtctgtgccatttcatttcgaggcctggaataaagagtgatgacactaagagaaggtttggttctaaaatacttctttattttcctgatttttaggttttttgtttcaattggaaaattcctagtatttttgtgatgtcagtgaagaaactgatgattaaagagaaagaacatgagttaaacagaatgtacaattcagaaactaggttttcaattatagttatatttttaggaaaaaaaggtaaagcaaatctaattttaaaattcagtcaatacgaaagtgtgtaacgcaaaataaaaagcaaaattaacctcacacctacctattaaaagagtttccactgttagtaatttgcagtatttactttcataactttttctacatatgtataaacatatatacatttttaaaatatgaattatttctcttcactgtatatttgtatgcagaaatatctataatgcatacctaatagcactgctgaattatatacttgcttgagttgcatactgttgcagccctacaggtacatatttttatttacacaacttggatgattttcattcagtgaaacaatttattaatttattccttccatgtcaatgaacgtagagctttattattattttccatggttttcagggtattccataacacagacacatcaccatttattctttctgtagtagacatttaggggatttaaaatgtttacattataaatactgacaatttagtaattagtgtcttagataatttattccaagttaaaaacaaaaatagagatttaatgtaagtccaactgagaaatctataaagtaggcaaaattttaaagttatcatacacataaaaattcaaatgtattcttatctactcatagttttagtaactcctctgataaaaaagagatcatagtagaaataatcagatatgaaaaaaattaaagatttaaaaatttggtatgtattactctccactgaagacatgatcttattggtaattattggaacatcatgctatctacatacctattattttagatatttatctatccacatagattccacgtcatgctgacacacacacatccaggtgtacacacacaatttgggcccttttacactatatcattttaaagtgatacgtgctgagatttcatctatgaaatagtcacccaattacagttcagagaatctccatctgaaaagaggtgaacacaattttcaccttgtgaatattcagaaattgaatccagggaagaaatttactgctagtgaacattgtttgtatatgaaaaatgagaacctaggaagtggctattttcataatgatataaatctggaaacacaactagaaatacacttcagctaagtaagaattgcaaagaactttgtactcgttcaaatgaaattatttcctggcagggaatttcttttttcagtttctctttaatttcattcagctcaattctattttgtaattaccaccttcataaaaagtaatcataataaccagttcttctgaagatagagaaacaagaatatggccaactaattacaaacgtttgggaacacttatcaataaaatgtataaaaccaattcattttctgccaataacatgatcatgtatgtctcaaatcacaaaagacgatgaattatgcaattatttttctcttgagatccttaaagattggagtaagaataaggaagttatattatttttccatagggactaaaacgtaatccacatgctttaatataatgggctgcttgtttgcctttctgtgagacaaggcaagcatatccaccatacacatggcattgatcagtcaataaatcttgctatgccaaaaccacaaatttaattggttcagcattagggatcccatatattagtttttctcacgaccaatcccgtttgggaagattctaatacatcttcaaatgcaacttctctattgtaaaactgataggtctagaaaatgtggagaaatacagtgggaggagaggaaaaggggagaaaagagagatgagagaggggagagggaagaatggggagagagacaatatatgtttttaaacatttggaaaccatttgcttccttttttcttttacataaggcaaataagacaatatgcatagaagtactttatgtttcaattttgagaggaataatttaagaaatgtgatcctaggcttattgtaagggatagactcattctcttatcttctaggagcaatttttcttaatggtttttgaaactgctgaccaaccattgtcattaaaaccctctctcggtttctaaaatactgaattttccttataccttataatcttcttgactactttgacttaacttttgacttagtttctatttacgatctaccataaaatagaaatgtttatttaataattatttatattctctctgtgtgtacacataaacacacacacacacttccacaatcctgttagaaagttattatttctaatttataataagaatacaatgaaattgtccatttaataggaaagcccaagataagatagtaaatcctgaagccacaatacaaacacaattcagtctgatttctaagactatgttctctcgtcacgccatgctacatgtgcccttaataccatggttcaacgttcttcagttctcttactgtcatcatttataattgccttttgagagatctcatccattcttaagatttgaatgtccacttctgcatggatggcatgcaacatctccagtactggcattttccatatattgctgtaccactttggaaatgcactgactctttaaaagccacataaatgttcagccattaaattcaaagttattatgtcttaataaaaatgatttcctcccatctcaaatcattattttctttcaactatcatatacaataacctgttacacaaatccgtacgttgtttatggtattttgaaaccatatttttatcttcattcttgtttgtaaaagataatctattattgaattctttcacacatcactctaaactcctttgcatttttctcttatccacttttactttcaagatttttatctaaccgctttatcccctacattgtgattcatacgcagcccctgggaagtgaggagtgcctctgcccaaccacgatgcaaccctccaggtgtgaggtggcagccttatgtgtgatctttctgccctccccaagtttgcattttcgacactaaagtttacttttacattaaaaataataataataatatagaaaaaggttttcctattagagtttctgtttctaaattctgccttaaatccaggttttataaaactatcgttcgggcattgtgcctcacacctgtaatcccaacactttgggaagccgaggcaggtggattacctgaggttaggagttcgagaccagcctagctaacatggtgaaaccccgtctctagtaaaaatacaaaaataaggcagacatggtggtgtgcacctgtagtcccagctactcgggaggctgaggcaggagaattgcttgaacccaggaggcagaggttgcagtgagccgagactgcaccattgcactccagcctgggtaacagacagagactcattctcaaaaaataaaataaaataaaacaaaactatcaatatttctagtgaaattcatatcactctaataccttaagatatattatcaaaatctcctacttaatcaagccctgtaatctcccatcagtgaaactcatacatacgtgggacggggaaaaaaacaaaaaaacaccttttcttattgctggaaacctagagtagttttgaattagaaattcagagttgctttgagttactgttattccatgagaaaaacagtattttatggatatttctaaacttaaaaagatagatctaaccaaagatggcttctcccagtgatttttgatctttctaggggcagtatataatccattgcaggaagctgtggtgctatcagaagctgaaacatcaagaacccagattattcacattcccctgcctcctatctcctctctctctccttccctcactgccccactcattgatcatttactatttcttttcacagtgaattatgcttttatcatgaatagtatctaggtttataagtgtacagtaatataaattctaaattcttcggtttaaatgtattaattttctctcatactttacatcctagaatgattatcttggattatggtgttcctagacattcttggagtattctttatcccaaactatttcaaatttaaagcttcaatctctaaaagactgttagtaaaattaatttaatattttacctgctcacctctttgctacactgggtctttcctatctgtggattctatatccatggactcaaagggacacagattgaaaatatttgagaaaaaaacaataaaaatagcaatacaacaataaaaataatacaaaaatacagcataacaactatttacagagcatttacattgtattaggcatgataagtaatctagagtttatttaaattatataggaggatgtgtgtgagttttatgtaaatactataccatttttaatcagggactagagcatctgcagatttcgatatctgaggggtcttgaaaccaatacttcacaaatactaaaagaagattgtacttctgtatctatctgttttttgtacaattgaaagattcagattcttccctttttatctcagtttataagcaccccccatagtttttctttcatctaaacaaatgatggaccatttaaaacagaaatttcatgcccacattcttagtgtttaaatctcttcatttatgttctaccttccatgatgatcacaagtactggatcactgtaccaattttttttctctttctgtatcttgatatcagaatgacattagaggaaaccacgtatttgtgtagattatgacactctaaacctcatctggtctatatgaactagttaaacatgatctttatcagtcaccttttccatttcccacataagttattccaaatggatacaaagcacctcaagtccctcatatttccaccgctacaaatgcaaagggtgaatataatcatatgggaaattgtggttattagtaagattccttcaatgtcctgtctgtatctctttatataacaaataaaaagaaaagcagccgaattagaattttactcattttcacatctttttctataggcccacaggatgagcttttcaccgttccctttttagaggggatttttccaccagtgactttgatttctatactttcatttctaccataacctgaattctgatctcaagtattttcaactaatgttcagacacggtggctctgtcatagttcttacagtcaagtctcttatttttctctcacaatttccacctccgagtagaaactaccctaaatcctcgcctttcattttcagtcaagtttctgaaaagaatattctatgaaatgtttttcaaatctggctgcacattagagtcaccttggggaggttttgagccacactgatgtccttttccctcctcaagaaattctgattccgttggtctagggtacagtgacaggcataattttgttgttgttgtggttttctcttttgttttttgtttgtttgtttttaaacttcccatgggatgggattcttttttttttttttttttttttttttgagacggagtctcgctctgtcgcccaggctggagtgcagtggcgcgatctcggctcactgcaagctccacctcccgggttcacgccgttctcctgcctcagccttctgagtaggtgggactacaggcgcccgccactatgcccggctaattttttgtattttttagtagagacgggtttcaccgtgttagccaggacggtcgcaatctcctgacctcttgatccgcccgcctcggcctcccaaagtgctgggattacaggcgtgagccaccgtgcccggcccttcccatgtgattcttatacgcagccgtattttgaaaccactgttctactaactcagacaatggtttctcattcctctctcatgtactccaaatactttctacttctacttctcccctaaaacagttcttttgaagggcactaatatctcccttgatttccaagtccagttaattatttttagtttttgtattattttttcatactgagtctcaacttttctttaaaagccttgctttctatgacatcattctttcgaaatccatttctatatttttctcagttttcagttctggttctttttatccttccttcctctcaaaggccactgtttcccaaccttctgctctttgctcctttttcgtccttctttgtaagcaccctcatgactccctcctcttgcagggttccattattacacattatgtttctgtagcccgtacagacttttgctgtataacatcagattcacatttaagaacctactaatggctgggcgcggtggctcacgcctgtaatcccagcactttgggaggctgaggcgggtggatcacgaggtcaggaggtcaagaccatcctggctaacacggtgaaaccccgtctctactaaaaatacaaaaaaaaaaaaaaaaaaaaaattagccgggcgtggtagcgggcgccagtagtcccagctacttgggaggctgaggcaggagaatggcgtgaacccgggaggcggagcttgcagtgagccaagatagcgccactgcagtccagcctgggcgaaagagcgagactccgtctcaaaaaaaaaaaaaaaaaaagaacctactaagtccttccagaatggtgttccagatccacctcaaataccacgtttctgtcaaacagcagcttctccacctgaactattctttctttagtatcatgattccccagccctgacactcatgagaatcacttgaggaaatttaaaattctgagactgggctgggtgcagtggttcaggcctgtaatcccagcagtacctttgggaggccgagacgacaggatcacctgaggtcaagagtttgagaccagcctggccagcgtggtgaaaccccatctctactaaaaatacaaaattaagcctggcatggtggtgcacgcctgtaatcccagccactaggaaggctgaggcaggagaatcacttgaatccaggaggcagaggttgcagtgggccaagattgtgccacagcactccagcctgggcaacagaggaagaaagagactctgtctcataaaataaaaataaaattctgagtctgactttcagaaatgttgatgtaattgatctggggtacctagacattgagattttaaaaatatttcaggtgcccctaaaaggttcaggcaatctgaaagttaggaagcacaagaatgaattttagtatcagggtattcaaaggtggtttcatattagaatcaccaggagagcaatttttaaatactattgtagacccaaacccatttcaactgaataagaatctctgaggttggatttcaggaattcgtatttttttaaagttccgcaggtgatgcttatgtgtaggcaaggttgaaaaccattgctttagtagtttcatctcaatgaatggcactgttttccacacaattgctcatccaggactgggagtcatgttaaacccagactttatcctcacctttctcttattccacactcaaataaaatccacatcccatgaatcctacatttataaaatattccttttaaacatcttcttttgaatgtctaatggccatttcaagttttaacatacataaaattaagtttttgacatttctacccaaaacaggacttgcaaagtccaaaatatcattttgacattttttcctaaaatagtactacaaataaaaaatcagtattgccaattttttgaagcaaacttatttgaataatatagactttttaaaaagatctttggattttgtttttctttgttcctttaggaaagagtattaaataataatatttaagattatagtactttgagtatatttagatagaatgatagaacaagaaatttaaagaacttctgttgttggaagaaaaaaacttataaaaagatttcatctctttgtcatgagttaaaaacaaacattttaaatgtcaataaatttccaaaggaaatttggcttatagtaaaaaaaaggaagaagtagtagtatattgagagttagtctcagctccttgaacttgagatgtttctgtctatgcccgtttcttgtctttttaaaaataatttaaatttagagcaataatctgttatattatcctctgtttttaatattgattcatataatttcttagtgtgctgcttcttttgttctttcaagaaaaatgaaactacccagagatggatttgcaatctaggttttcactaccttttgtgcccctgagagccagtaaatccagtctgttttgataatattttagccatgacacaggccagtcatggcaaggaaaaaaaaatgaattcataagaaaaaaatctgtatatttgtgaaaaaatcaggatctatcatatcccaagtttatttggtggcattaacatataatagtccatttgcttactccccataaatatgtaaaaaggcaaagagaaagtaaaaaataaaattattcttccactcacacaagtggctgaataggcctaatcaatattaacttcattgttcccccataattctatatgtttagcttttaaacatctatcttttaaatatgctatttttattaatttgaagttaatcaactaaaataggttcattcctttcactttaccagtattacaagtgactgtctaggagcctgagttctaatgaggcagccattccaaacatgtacagacaaagcagtggtttccctggcaacgagaaccatgaaaaagctcttagaatagttattcccacccttacacacaactccttttcatttcagtaaagcttcctgtcagaacacattcatcaatgtaatttgccaacaaagtttaagagattaaatccccctccccacaagaatgtaaaaataaaaaaacaaaataaaacctacaatcaaaaatcaacagctatgctgaaattgtagttaggtcatgaggtaatgcttcaaaggaagtaaaggacatcctaagactcctgaatacagttaacaccactttgaacctgagattaattttcatttgatttttatcagaggatacagaaggtagatgcatcaggaggaggggcaggtgcctttaatcattacctctagcattatcacttacaacctcaaagcagcttttatttaatttagtaaaagtttataaaaatttaaattattgtatgcatcaaattaagatttaagatgtccttcataaacattaaccttttgttggtgatgtttaccaagaaaggtaaactctgaaaacatgatgtcatcgtttcaattggtggaattaagtaaaagattttcaaatgaagcacttgaacctattttctatctatgcatgcagtagaaaaaagcacacaaaacaggcagcattttgtgtcatgtggcatttcaaacaagagggaaaacacatctggaaataaaaggtgtttagttgaaagaattgaccttaaataaaacaattgcaacacttgatttgggcttcttactggaaatcaaattctttgagtttaaaatacacctactaaatgtaatacaaaaccaaaataacacactttcagcatttctcaaaatgttagcacccagcaaatgcagagtttacagttctagtgattttccctgttcttttcatggaatgcatatctaacccgtttttcagccagcatgctacagcaaaggaagattcatgttgtccagggctatttctttaaaacagtatggaaattacttttaccataaattaggttgtgctttaatgctgagaaaggtctattttgccttcattttgacccatgacatacttagccttacaacagcataatgagcataatgaggtcaaaactaacactgcaaaataaaacacacccccccacacaaacacacattatttctcaaggaagatgaaaaaaaaaaaaggtcacattgattttcttttttttaaagcgggacattctcactacttttttcacctgaagattgaaaaggaaactcatttcagtttgtaacattgcactgactgttccagacacaaaatgaatcaagtctcctgttggattatgtggttagcatttcttctcttctctggtgagataattcgttacttaggacagctgtggtataaaaactcaaacattgtcttttgcagaatggatttgaaaagtgggcccccattctatttttgttagaaaataataaaatcacaaattttgtcatgtatcaaaaatgaaaagtgaaatataaatgtgaaaggtctgatatttacttaatgaatatttaccaaatacttagcatttgcatattaagtacaagcctcagggaaaaaaatgtagccgtgtttaaatctcaactttatttcttccccttgctttattttttgaaaaataagaaatattcacattaaagaaaaaagagaacatatttaaaaatattttcatctatattctagtctaaccagagtatctataatttatattagttaccaaatgtattagacaaattaaaacacaagagtttttattattataatgcttttttaaaatatggacattcacaattttatgcttacaagagaatatataattcaagtactcccatgaaataaagtaccagttctctacaatcaaacctacagtgctaaacgtcagctgaaaattacttataaaactttcaattaaacttttactagtttaggtattctcttcatagttgagaaatataatgcaaataaaagttgagtatgcctccctgcctccaactaggacataaagttgatcttccatgtcatgtttcttaaaagtaactctaaaataagtttctttcaaaccttctaaattattctctttccctaatggcttgttgtattcttccccagcagaaattactaaaatagccctattgcacttaatctaattagggatttttggagaaatggtggttacatagttctcattaactgactaaaaaactgtaccatctccagaggtatagatattaaaaagcgggggagggggatgattccttttaaagctccagaaatgaatgtaagtgttcatattctggtacattaacagtttgttccagtacattgatattttatgtggaagccctactctgcaattaatatgcctgatgcaaattgaaaaacccataatccatccttctctgttggaatgtaagagtatattattattgagaagctacaggataccagaaccattttttaaacttgactgctcactaccttaaatctgcatataaaacagttttgcattcagacgaggtaatacataccggaatatattgtggcgcatattaaaaaaagtgctccaaataaaaacgacctgtgggcttcctttgtagaagaaatttatgcagttccaggcattagggattaatgacagctaagagcaaaagagaaggaatgagcattaaaacattgtgcctaactttcctgactaccccaaggctaaaagacaaagtgaattgtcaaatctccttaaaggtaaggactatgaatttatattaagtaaatatgatatttggggattgcatctggttctgtcacattagtattcagtatatttcttatagctttaaaggagaaaagacaaccttaatggaggtatgagagaagaaagattttaaaaatcctttgtttctaacagcttagagagcctctttcctttgtcttgtttccaaaattatgcatacaattcttcacaggacataaaatgctattgtctgctatgactgacaaaatccaagattttaatgaaagttatactgtaactattttaaagggaaggggaatcacacatccctaagagattcaaatgtaatatattctcaaaaatggaaagatcccagggatacagatttctttctttcacggatttctcctaagcctgttcaattcatttgatcatcaccgcctgtgatctgggttttattaacatttcagcatttgattggacccttcttacctctctgtctatccatcacttaagacatttagtgctgcctactggcagttatctgtgtaattgttttatttcactcactaagtgataagatccttgaggcaagacgctatgcgatatggcctgtatcttccacaataagtaatcacattgattcaaaagattccctcacaatacatttttattgcaaaaatgattttgtatttatccattttggaaaagaaattttatctcttgagcccctaaaaatggaattgtacacattaagacccttacacatatcacataataatcttcagggtcaaacattatagttttcacctgctgctattcctttgcagtagactagaatagagaattatataaaacttctatgactgtcaaaaaaatgatatattttttgaaatcatgtaaaatcaaccttctttattttacagatatagaaatttagatctgtaaggaccatcagtgtggtgaaggtcacatggtaagttaattacagaatcaaatttttccctttcatttcaatctgtttttaagttttacatgattccactttcaggaaaaagcaattaaaatacagactggctttggtaagagtgatatatatttttatgtttcagaccagcatgttgtttcatgctgatgttaaaagataatggttgatatcagataaatacccacacatacacacaaacacaaactaacttggggtccaataaaataagactgggtggttcacatatttttccattagtgcaaatattttacagagataattttctttgataaaatctgtgttcttaaaactgattaacacatagtccttactagaaactctttacaaaaaaaaaaaaacaaaaaaacaaaaaaacaaaaatgagagtgcaaaaattgagagaataagtcaaaggaaaaagagaagttctcccataacttaaattcattgtacctgtacattaatcaaagaacaaaattgactgtcatgtgatttgactcatgctaaaatgtccctcacaatgaaaataatctcttttattggcccctcacagtgtttaaaatttttcaccatttaaaaaaaaattgacttaaaatacttcatcttctgacatttttgttcacaaaaatagtaaaagtaaaggaaaaaggtagataatataccaactttgcagggtattgcaggaagttcagagagggaaagaaagaggaactataaatagttatcataaattacagctaaatattttagtttagcataaagagggtatgatgaatgtaaacaacatcacatatagttcaaagtagagttgtggaattagttttccatgacaatgtttaagaattgtacagctttgctgttatctagtgatgtgtccccacccaaatctcaccatgaattcccatgtgttgtcagagggacctggtgggaggtaattaaatcatgggagcaggtctttcccatgctgttctcatgatagtaagtttcatgtgatctgataattttataaagggaagtttccctgcacaagctctcttctcttgtctgctgccatgtgagacatgcctctcaccttctgcaatgattgtgaggcctccccagccacatggaactgtaagatcattaaacctctttcttttgtaaattgcccagtcttgggtatgtctttatcagcagtataaaaacagactaatacagtaaattggtaccaggagtggggtgggactctgttctaaagataactgaaaatgtggaagcaactttggaactggataacaggcagaggttggaacagtctggagggctcagaaaacaacagaaaaatgtgggaaagtctggaactccctagagacttgttctatggcttgaccaaaatgctgatagtgatatggacaatgcaatccagtctgaggtggtctcagatggacatgaggaacttgttggaaactggaacaaaggtgactcttgttatgttttagcaaagagacttgtggcattttgcccctgccctagagatttgtggaactttgaacttgagagagatgatttacggtatctggcaaaagaaatgtctaagcagcaaagcattcaagaggtgactttttagccggacatggtagtgtgcgcctgtagtctcagctactcgggaggccgagacaggagaattgcttgaacccaggagggggaggttgcagtgagctgagatcataccccactgcactccagcctgggtgacagagtgagactccccaaaaaaaaaagatgtgacttgtgtggtgttaaaagcattcagttttaaaaggaaaacagatcataaaagtctagaaaatttgcagcctgacaatgtgatagaaaagaaaatcccattttctgaggagaaattcaagctggctgcagaaatttgcataagtagcaaggagctgaaagttagtcaccaagacaatggggaaaatgtctacagggcatgtcagagacctttgtggcagtccttctcctcacaggctgggaggttttagaggaaaaaatggtttcatgaggcaggctcaggttccctctatgtgcagtctagggacctggtgccctgcatcccagctgctctagccatgactaaaaggggccaaggtacagctcaggccgtggcttccaagggtgctagccccaagccttggcaggttttacatgttgagcctgagggtacacagaagtcacgaattgatttggcaacctctgcctagatttcagagaacgtatggaagcacctggatgttcaagcagaagtttgctgcaggggcagggtgctcatggagaacccctgctaggatattgtgaaatggaaatgtggggtgggcacccccacacagagtccccactggggcactgcctagtggagatgtgaaaagaatgccatcatccttcagaccccagaatggtagctgtaccgacagcttgcactgtgcacctgaaaaagctgcagacactcaatgccagcccatgaaagtggctgggagggaggctgtgtcctgcaaagacagaggtgcagagctgttcaagaccatgggaacctcctcttggatcagtgtgacccaaatatgagacatggggtcaaaagagatcattttggacctttaatatttgactgccctgctggatttcagaatttcatggggcctttgttttagccattgttttttccatttgcaacagctgtacttacccaatgcctgtacccccattgtatgtaggaagtaactaattttcttcttattttactgactcataggtggaagggacttgccttgtctctgataaaactttggactgtgaacttttgagttaatgctgaaatgagttaacactttggaggactgtttaaaaggcatgattggttttgaagtgtgtggacataagatgtgggaggggccagggtgaaatgataaggtttggctgtgtccccacccaaatctcatcttgaattgccatgtgttgtttgagggacccagtgagaggtactgaatcatgggggcaggtctttcccatgctgctctggtgacagtgaataagtctcatgagacctgatggttttataaagggaactttccctgaacaagctctcttctcttatttgctgccatgtgagatttgcctttaaacttccaacacaattgtgaggcatccccagccacctggaactgtaagtccattaaaccttcttcttttgtaaattgcctagtcttgggtatatttttatcagcagcgtgaaaacagactaatacagctagggtggttaagatagagatatgggcaagatagaaatccttaacaataaatacatacattacattgtttcttccatctaggatggttcttttaacctacaggtaatcactttgtgtgtttcattaaggtattttcaaaatctctttgaacagcataacttttaaaagcaagtactaatactttataaaagtatttcataaagtagtttacagtaactgaggttgatttgtgccgttaaggaaaaaacttttacttttttattactaaaaatgtatgtaaatctcactggcactgaatgcatttttcaaacaaataaagaggcttgaaatggtgaacagctattcttttctgcctactagggatgagaaagtacaggctgttttcaaattaaaaccggaagcatatacaatgagacattatgtggactgttgtgactattagggttgttagatcatgtgctgtgttactgtgggatgtttgggaggatcctttgaatatattttattatcaaaaattttatttttctgatgtatataatcagaaactcttgaagtagacaactatataaatattaaatgctcacttccaatataatattcatttgattaataaaactggagacaatttatcttagttggtggattatactatactcatccttggtagattataccataaaactgaagtatttccacctcaggaaatattcccaccagttaagttgatgtgcattgccagagtatagttactttgttgaatttccacatgtaaactcttttattgaattagatatgtagaaaagtcattgttctatgcttcatcaccagttacaagtggcatttgttcttctctatataaacttaacatagaaaaattataacctacctatctgtatattctacacaatataactgctaattttatcatcggtgagatggtacaaataattcaactgtcaaattagactcatatgaaatagaaatgtttaatcatttttaggatataaaagtctagtgtctagaggctcagggagaactaaggtgagaggttgagtattcactggatctcttcctactacgataaataagttctgacacattacttacacaaaagataaaaagtatcagtaataaacacttccattttataatcaaataggcacaaaggatgcataatattttccaggaagcgatgccccatatatccatagattctagggttgctttttttttttttttaacacaggagatgctaaacaaccaagtacatgctgctaaaaacaccttgcagataaaaaccctcccactagctaacgtaactagcttgtttgcaaaaagtctgcttttagcatgtttacaaatgtattagtctgctagggctattataacaaagtatcatcaaccaggtggcttaagagtgggaatttattttctcacagttctggaggctagaagtctaagatcaaggtgtcaacaggtttggttcctcctgcggcctctctcctttgcttgcacatggctgcctccttactgtgttctcacattgccttttcttgatgcaagcacttcactggtgtcttttcctcttcttaaaaggacaccagtcctattggactagggtcccattcatatgaccttaattaaccttaattacctctttaaaggccatatctccaaatgcagtcactttgcgggttagagactcaacatataggttataggggaacttgatttatttcataacaacagggatatgacttttatttccttgtcctctatataaaggaagagcctagatagcagatctgcttcccatcctttttttctcaacgaagaaggatttatgttttccaaaaacaaaaaaaaacaaaaaactcttgaattttatctcacgagagcaaataaattcaatcattcagcccctaaatgcctcaaaagtctgtagaatagagcagcttcaaaagaacaagtgggaagtaatgaggaagagtaagagacaaagcttcacaaaggctgtgttaaagaagaactcttactcctagtgaattctgagatgatatcacagactcaatttatatgcaaacctgaatttaagtgtactaaaaatataaaattcactttggagctaatgaagtaacttttcatccaaaaaaaatatattactttaagtatttctcctgtagtaaaagtatttaccgttttattcatagctttggattgagcaaatatatcttaagatatatgtgtcataatatagactataacataaaatgcgggtgaacacagtaactcacttttacatcataatcaagtcattagcttctcatttccgcaattaaaagaaatatgtcttatgagctattcaaaatcttaggttagagaaagttaccaagtaattagctgccattctggacacacagaaattagagtaacaaaaccagttcacacatagatacattctttgagagacagaatagtggattaaccacaaatataaagtagagaatgcagagaatgcccctgatggaattctcaagaaaacaatttctagtgcacacagttggctgcctaaccctcttacattttccttatctttcttttttttaacagaatccatattttattcagatatccattctatctgtaaatcgtccctgtgtttagggaaagatcagctttatccatagaagggatatctgaataaaataaacagaactccccagttccagagttgggcctcagttactcttagacaatgtgggtaattattttcccattgctcctggttgtttcaaaaaatcagacatacatcagtcagtacctgtgtttgtaaattgttatctgggaataaccagacagtgcaaatagtttctattataatataaagaaggaaagacttctattcataaaaggggaaaactctttcccttgtattcactggatttgaatgagaaatcctgtactgctcattgctcttaccagccattgcatactacaaggggaagcagaagtaggatgaagctaataggtgaactgcagggtggagaggcagaaagaatgtgcttccttgctgagatctctgaaccataaatcaagcagagctgaaaacttttctacctatctacttcaaatatataatatacaatctcttcattgtttaggtgggctttatttgcagggtataagctgtaagcaagtactaatactttataaaagtatttcataaagtagtttacagtaactcaggttgatttgtgccgttaaggaaaaaacttttacttttttattactaaaaatgtatgtaaatctcactggcactgaatgcatttttcaaacaaagaggcttgaaatggtgaacagctattcttttctgcctactagggatgagaaagtacaggctgttttcaaattaaaaccagaagggccaaagatgtaaataaatgtgactgatagaggacagcataaaagaaaaaataagtttttttttttaaagcaggactgtgagaattttaatagagtctagattggtgaataaaaaagaatagaatatcccaaaaagtgtatattaatgctcaaaccagtaaagaaatatgagttaccactttgtggaaaaataacatgggtagattcatatgcccctactgcgtgtaagattatttttaaagagattaaagcattaaatgtagaaaataaaaccacaaaggctctagaagtaaacataggacatttcctttataacctttaagtggttaaggtataagtaattataactaaaagtctagaagctaaaagattaaaaaatgggtatatgtgaatacagtaacaataacttcatgaaaaaatattgtaaacattcacttctcagtcttttggctaagatcaagtgaaatattgtaaacaaattgaaactacaagtaatcaagtaaagaataatatttactcttcatatagtataatttctttactatatgaagtgtttctagaaatttatgagcaaaagactcaaactcaaaagaaatataggcaagtatataaacaattgatagaaagtaaatgcaggccgtcgcggtggctcacacctgtaatcccagcactttgggaggctgaggcggtttgatcacgaggtcaggagatcgagaccatcctggctaaagcggtgaaaccccgtctctactaaaaaaaattaaccgggttttgtggcgggtgcctgtagtcccagctactcgggaggctgaggcaggagaatggcgtgaacccgggaggtggagcttgcagtgagcccagaatggcgtgaacccagaaggtggagcttgaagtgagccaagattgtgccactgcactccagcctgggcaacagagtgagactccatctcaaaaaaataaataaataaaataaaaataaaaaattaagtaaatgcaaatgacttttaagtatacaaaagtgtattcaagttcaaccataataaaactacaaataaaactctatcaatattctttcacttattagaatagcatatttaataacacaaacttcagcaaacatatagagaagtaggtactaccattcatgcatccacatgattggagtataaattagtacatatttatcaaataaaaaatgcatgtgtgcatgtccaatcaattatactctaggcagattatcctaaataactacttacatataaaacgacatatatgactatattcattgcagaaaaatatataagaacaagattctgaaaacaacaaagtttttaatatagtacgacttaatgatgacacatccctttgatgttctgcaatagtaaaaatactgaaaattttctatatgtattaacgtggaaagtttttcaagataaattgctaacgaataaagcaatgtgccaaaaggatacgtgttatgctgtccaaataaaggaaatcaataatgtattttgttatctcttatatatacataaaatacttaagacaccaagaagctgttgttaagaggtaagaactgggcagacaatagaaaaggatagaatgtggaattttccaattctgtatcatgtaaatgcatcacctgttcaaaaaataatgttcacggttccctacattttctgagaaatatccaactctttagccagtaatttacagcctttcaaaattgttccggtaatatttcatttttcttgctcatgctaaaccaccttctcatcaaactattcagtaccttaaattctactaaaatttctttgtggcatcacacacatacccatttcgatacactctttttctattatcacctgtagaaacctacataacttcacagcacatctcagatgccagctctttcaagatcttctctgataaacccaaggagaaataatttttccctcatcaaaatccttagtgcacttgggattacatcacatattcttcttataggagtggtctttctattagcattgaaggtccttaagagcaagattgctttttaaacatctgtatttcttaaagtattctgtgcaaaatactatgctaaaccctgtatttactcaaacattttagcttaatgaattaaaatatgactcaaaatggaatggtaagttgttccatcttaatatattaagaaatatcaccaacagcaactacatcaagaaaccaagaagacaaactttaatggaatatttgatggacgctgaagtgagtctattaacaaaaacaaacaaaaagaatcagggactacatttgccattaattctaaaattgttgccatttagggcctcactgaaatatagggccaaatagctgttgctctaccagtagcagttctcatattaaatgatgaatttgcaaggcatgccccctaggatttcatctgttctccttgagaaaatgtcaataacttctataaagaaagagtggccctagttagagttttttagttccaagtctatgtttaacccattaagaaataattcatacttagtatatatttttaaaaaacactaaaatatagtctaaattttcctgattttttaaactatgtaggaattatataataaaatgtgattacctaagagaatgttctggtttttaggacatatacaataaagtacttaggattaaaataataagatggctccaatttgcaaatagtatagaaaggagagagagagagagagcacactaccaatatattcaaatgtaatttagaaaaaaatctggataaaagggtatataggactttcttctactattcttgcaacttctttctaagtttaaaattatgtcaaaatggctgggcgtggtgactcacacctgtaatcccaccacttcgggaggctgaggcaggtggatcacctgaggtcaggagttcgagaccagcctggctaacatggtgaaaccctgtttctactaaaaatacaaaaaattagcctgaattgatggtgagcacctgtaattccagctactcgggaagctgaggcaggagaatcgcttgaacccaggtggcggaggttgcagtgagccaagattgtgccactgcactccagcttgggcaacaagagcaaaactccatctcaaaaaaacatagtatataaaaataagagttacacacacacacacacgttaatgtccaaccaggcaaactgagtctatgttaaaattcggtcatcacctgtaaactagttcaaccattgtggaagtcagtgtggcgattcctcaaggatctagaactagaaataccacttgacccagccatcccattactgggtatatacccaaaggattataaatcatgctgctatacagacacatgcacatgtatgtttattgcagcactattcacaatagcaaagacttggaaccaacccaaatgtccaacaatgatagactggattaagaaaatttggcacatagacaccatggaatactatgcagccataaaaaaggatgagttcatgtcctttgtagggacatggatgaaattggaaatcatcattctcagtaaactattgcaagaacaaaaaaccaaacaccgcatattctcactcataggtgggaactgaacaatgagaacacatggacacaggaaggggaacatcacactctggggactgttgtggggtggggggaggggggagggatagcattaggagatatacctaatgctaaatgacaagttaatgggtgcagcacaccagcatggtacatgtatacatatgtaactaacctgcacattgtgcacatgtaccctaacacttaaagtataatttaaaaaaaaatctcagaaactagagtcagaagaatagccaaaaaaaaaaaaaaaaaaaaattcagtcatcactatctttaatggatggaatggagtttagagtaaatagtgcagggaaggtagggttatgaggttttagtgttctctttcttaatctgcattctgattaccagattattgttcacttgataaaattttatcaaattgtgccctgataatcagaatgtaagaatgtcacattttctgtaagatatccttcaatgaattttaacaaaaatattatgaaaaaataaatttctcttttttttacttgattaccctattatagaatgcatatgtttagtgactttgtatagtgataagaaaatacctcaaacaggattttaaaaaacgtaaaaagatgtaaatgacacttttctttattttttattttatttatttatttatttatgataggatctcactctgtcacccaggctatagtgcagtagcatgatcacagctaatttcagccttgaccttctggtctcaagtaatcctctcaaggcagcctcccatttagctgggaccacagacacgtgccactatgtctggctaattttttgaatttttggtagacagggtctcactttgttgcctaaggtggtcttgaattgctgggctcaagcaatccttcagcctcagcctcccaaagtgctgggattatacgcatgagccaccaggcccagccacttttctttaattgaagtgctatagccaataccaaagttgatggcctcccatccaacttacaatttacagtatagcacctatacatttagtctgctgctctaaatgtctcccagtaatcaaactgtgtgtgaaattcatagtatggggcatactattttttaatcattctaactactgtaattatgtccttatctgtattcatgtcctgaaagtttatgcaagtaaaattagcataatgacatttaagttatttcatgtttatgtgcatgcatttactggacattgctattttttacaaccttacattttaaatttctacttttcatccaagaactctctcaaaatgtttgacttaccttcttttgtttttacatttttctgttcttcaattttttcattcatccaacatatacttaaatatctaagttttaaggtaactatatgtgccggtatatttgcctataaatcatcatgcacatagaaaacacttttagaagcttcctctttcataccaaattcaaaccataaggtctaaaggaagtacttagaggttgtggtatacacacatttattttactgaaaactgaaaataacgcagacaaaaggatgaaacttattgggaattggtatgatatataagatatctttcactcagaaaaaaagtaagaatataccatactaagttcattttcttcaaaaatttggatcctttcattttctagggctgcatatcctttttcctaaagaggaactccacattttataagttgcagttcccataaagactagatctgtccctagttttgatgaactatacctgggaaaccagaggtatggcaatcctaaaacgaatataggaaaagagttccaatagacacagattcccttcccctggtgaaaatgaagatagaaacaacaacaaaaaaagatattatgtaatataaaataaaacaaatgttcattatatttgaacctgtattctcttttctaaactgagtttcagagggcaaggaacatgtctgtcagatactactttctatccagtatacatagtagctgcacaataaacatttatgacatgaattaattagcgtttctctggcctgccaatgccctgtatatagaaaatctgtaaatttccactaactttaaaaatactcatattttcctggaacagaaagtaaagattacatggcagacaaaattgcatctgtctactaatgattaccatgtaatctttactagatggccttgtggttctcagtaagagtcaagtgacaaaggagacagagggagcaaagctgaaagactttaataaactctctttgcaaataatgtttttattcaatgtcaacttcttattaaaacatcccaggtcttgactcttctgagtcttttatatactttttttctacaacaaaggagaaagcaatcactattgatttgggcacatatcaaaaaatgaaaaaagagaaataaataaatagttgcatttcaattgtggccaccatacagctaatagtttatcataactcttaaaggttggtccctaggctcttatacaggttcaccctttgctgacctcttacaatctttctgtcagcattttgaatgctactgattctgtgagtaatattttcaacggaggtcagacaggccagtaagtccagcgtgccctctcacttacgaattccccttcttttgtggcttttcaccatgggttcacatgtcatggactctacatcgcaaactgcagtaaacaaatttcaatcgtgagtgaaaggagaaaaaagcaaatcctacttgactattgctagcttgtttacaccatagggctagagtaagctgaaatcgacagagtataaagaaaagaaggtcctcttgaagtaacacacacactcattttcagactcatagtttaaatgcagtcttttatttgtcactaccactgcattgttatcagaggatttatatgcctagagctgccagaagtgtcaccagctctgacaatgcccattttggagctttttccgatggcttattttatttatagtcttgatgaaactggggcagtcacaaaactgattagcgatctggcaaacagggcctgctctgctaatgatctgtgtaaatattgtgctgtagagcctttctgtgacaggtcattgctgctaacaaaccgcagaatgcaaacagagacctgtgctgccttcactgcagatgcacagcagccagcttacactgacaaagcaaatgaaaatcctcttattgtcgatcatctcaagcaaaatggcctaaaaatcaattctaggataggctttctttctttctcgaagctttaatctggggatgatgacagtgataatggtatttcattatacacataaagtaagagagaaaaacgtaataaaacaagatataaaagatgaatttaaacaatggattgtgaaagccttgctgtttgcttctgtttttaaaaatattttgctattttttcttggctgctgccgttactacagttgtagtctgcacagaatgaagccttaatcacacagtcatgctgaaacatgtttacaaaggtaaaattaatgggtttatcttaagcaagatgtctttctatggcatcattaatatgctttagattttttaaataaatgtgtttttattcttccagtacatcagaattggaattggagtcatgtcaagatgttctcactggcaaagacaggaggaggttaaaatagctccttgtagggcagtaacctcgggagaaaaagaactaatagaaaataaatggcgagtattttttttgaatcatttgtatgataagcttataatgtacttgtctcaatgcagaaagcacaaggaaaaaataaatatgtcctcatcacattggtagacaaagcactaagcacgtaggttgtcagaaattcgatatccctttctcttttctatatcctctaccaaacagaaagttccacatacatctgagacttcagtgtctatgtgacttgagtacaatttcctttttcatctttgtttttcctttacttactcgtttccctttattcttacctgagatatagagaataaaaaataacactatagaatcaacctttttttctaggtaatttagaataaattttccagaacataaaaagggtaatgatggcattatgtaaatttgagaccaaaattttctgaattaaattatttttacatagataatggttcacttctgattaggaacattaaataaaaagtaatcttaacaatatgacaatacaacttagccttcttgcattatcttttttagcctaaatatttaattattataatttgcacaacatcgaaattatagtgcaattcttttctttacaaaataatcacaataaagtattttaatcaagcaactgagcacatacaattattattctatgtccataaaatttttttgcagaaaacatttatataagaatttcagtagtcaaacattgagtagcaggaaaatactattaaattttaaaaaccaaacaagcattggaaacagaaaaatggatacgaagagaagcaagtattctcctgtatttataattgtggtactttacaatatatgtaatatatctttagaaagattaattgtcttttattctcacagaaattctatgagccaggcagaggaactgtttttgttcccattttacttctgtaaaaactgagtctcaaaataactgctccccagaagtatagaatgattaaaggtcagaaacagagcctgcatattttcatatttgttacacttttttagctattgttgtccaagagtactcttacttttgagatactttctttatttcactgttcagaatttttatatttgtatgatttaacaaaataatcggtaaatttcatttttggggattaaaaattaggttgtggaagctacattaggttgtggaagttgtgccccatctgagacaaatcttggattaatcagtgattgattaaattattgaaagtttagttattcaaagaaattggcatagaagtacattaagctaagctttatctggtaagatggagaactaacatgatgtgggcttctttctgtgaccacaaccctggaaatgacacagaaatcagcatctaatactaaaagatgtgagaaacctttgcagttacaaactacagtaaagtctgcgagtagagaaaaaaatgacagcaaagagcagaaaactgagatgtaaggaaaccagaatatgctggggcggaagtttttagtggtcatcattccttttcattgcattcctgtatttttttctgctctttcaatagttagagtacccacagtgtgcaaggcactcttctaaatactgagaatacactacagagccagaaagacaaaactttgaccaaatggagctcccattctagcaaaactagagttgaaaagagaccactgctaactcctttaaagccattttggagtcggccaggcagaatatgactcaacctagcttggaaaatgaggaaatagtgacaaatgcagaaagaccatctgaaccctaggcattctcctctaacccagctactccatacaatgagtgttaggatggtgattaaaactgagggagaccagtcttggtaaacagcaccacccaggacacgtgaatacaccaacttttatggaggaggaaggcaaacaaagggtggcagaatccagttatttcctaaggagtccttcattctaaacacttctggtgggtcaatcttgagcctgattttagtgccatgtattcttaatcagcataataaatcttactaggaaaaaataggcctcaaaggaattcaatgactctaaaataaaatacatgtatatcaaagacaaccagatttacaaaaattaacaatagtttaaaatatgtgaccatatgtggtggtttacgtctgtaatcccagcactttgggagtccaagacaggagcattgcttgaagctaggagtttgagatcagctcgggcaaccaagagagcccctgtctctacaaaataaataataatttaaaaaaatacctaggtgtggcggcatgcacttgtagtcccagttaccaaggaggctgaggcaggagaatctcttgagcccaggaggtcaaggctgcagttagctaggaggctgtcaccactgcacttgctccagcctgagtaaccgaaagacactgtctctgaagaaaaaaaaaagttaaaataaatccaaaaatatgtatagtaaatgttctcaaagacataaggcacaatatttgaacctgaagaagaaattagcaatcataaaatattttttcagtatgaaaaccatatctgttgaaatgaaggattaaatatatggtataaacagcagaagggttaaatttgaggagtgctcattagtgagatggaagataatgttcaaataataacaaatttttttttaaatttagaaaactagacttcacatgtactgctgatgggagtacagactgatgcaactatccagagagcaatgtggagtgaaatgaaatccaaacctatgaaccagcagtcctactcttgatccacatggcaaataaacttaagtttaaactcatgaaaggatatgatatccagtagagacaattgttgttgcaggaagttggaaggaggcaaagaatctatcactgtaatacacacacacacaattgtttataaaaatggaatacaggccaggtgtggtggctcatgcctataatcacagtgctttgggaggccgaggcgggcagatcacaaggttaggagtttgagaccagcctgtccaatatggtgaaactccatctctactaaaaatacaaaacttagccaggcgtggtgacacgcgcctgtagttccaggtactcgggaggctgaggcagaagaatcgcttgaacacgggaggcagaggttgcaatgagccaagatcacgccactgcactccagcctgggcaacagagcgagactccatctcaaaaaaaaaaaaaaagaagaagaagtaatagtgtgctgtgcagcatgaaaaaaaaatgaggtaaagatacacacgataacaataataggtcttaataatatagtgttggatttacaaaagtaaaaactatatatacaacatataactcaaaaacaaccacaaaattttatagttttcaaaaaatgcatattcaagggtctaccacaaacacatgaatgcaattgaagtaagagggagaagcagaaggaaataaaaatagagattagagattagggcaagataaaataattagataaaataaaccaagaaattcctattttatttatcatgataagaatgtactttaaaaagaggatgactacataaaatgagttagggaggagtacctctttttctattgtttggaataatttcagaaggaatgataccagttcctctttgtacctctggtagaatttggctgtgaatccgtctggtcctgggcctttttttttggttggtaggctataattactgcctcaatttcagaacttgttattgatctattcagggatttgacttcttcttggtttagtcttgggagagtggatgtgtccaggaatttataaattttttctagattttctagtttatttgtgtagaggtttttatagtattctctgatggtagtttgtatttctgggggatcagtagtgatatcccctttatcattttttattgtgtctatttgagtcttctctcttttcttctttattagtctgggtagtggtctatctattttgttgatctgttcaaaaaaacccctcctggattcattgattttttgaaggacttttcatgtctctatctccttcagttctgctctgattttagttgtttcttgtcttctgctagcttttgaatttgtttgctcttgcttctctagttcttttaattgtgatgttagggtgtcaactttagatctttcctgctttctcctgtggacacttagtgctataaatttccctctaaacattgctttagctgtgtcccagagattctggtatgttgtgtctttgttctcattgttttcaaagatcttatttctttctgccttaatttcattatttacccagtagtcactcaggagcagcttgttcagtttccatgtaattgtgcggttttgagtgagtttcttaatcctgagttctaatttgattgcactgtggtctgagagactgtttgttattatttccattcttttgcatttgctgaggagtgttttacttccaattatgtggtcgattttagagtaagtgtgatgtggtactgagaagaatgcatattctgtcgatttggggtggagagttctgtaaatgtctactaggtatgcttggtccagagctgagttcaagtcctaaatatccttgttaattttctgtcttcttgatctgtctaatattgacagtggggtgttaaagtctcccactattattgtgtgggagtctaagtctctttgtaggtctctaagaatttgctttatcaatctgggtgctcctatattgggtgtatatatatatatatatatatatatatatatatataatcgttggcactccttgttgcattgatccatttaccattatgtaatgtccttctttgtcttttttcacttttgttgctttaaagtctgttttatcagatactaggtttgcaacccctgcaaggctacagtaaccaaaacagcatggtactggtaccaaaatggatatatagaccaatggaacagaacagaggcctcagaagtaatgccacacatctacaaccatctgatctttgacaaacctgacaaaaacaagtaatgggaaaagtattccctatttaataaatggtgctgggaaactagctagccatatacagaaaactgaaactggaccccttccttaacaccttatacaaaaattgactcaagctgcattgaagacttaaacataagacctaaaacattaaaaccctagaagaaagcctagtcaataccattcaggacatagacatgggcaaagacttcatgactaaaacaccaaaagcaataacaatcaaaattgacaaatgagatctgattaaactaaaaagcttctgcacagcaaaagaaactatcatcagagtgaacaggcaacctaaagaatgggagaaaatttttgcaatctacccatctgacaaagggctaatatccagaatctacaaggaacttaaacaaatttacaagaagaaaaaaaacaatcccatcaaaaagtgagcgaagcatactaacagacacttctcaaaagaagacatttatgtggccaaaaaacacatgaaaaaaattcaacactgggctttacagaaatgcaaatcaaaaccacaatgagataaaaatgatgaattcatgtcctttgtagggacatggatgaagctggaaaccatcattctcagcaaactatcggaaggacaaaaaaacaaacactgcatgttctcactcataggtgggaattgaacaatgagaacacatggacacaggaaggggagcatcacacaccggggcctgtcgtggggtggggggagggacgagggatagcattaggagatatacctaatgttaaatgatgagttaatgggcgcagcacaccaatatggcacatgtatacatatgtaacaaacctgcatgttgtgcacatataccctaaaacttaaagtataattaaaaaaaaccacaatgagatgccatctggcataagccagttagaatggatatcattaaaaagttaggaaacaacagatgctggagaggatgtggagaaataggaacgcttttacactgttggtgggaatgtatattagttcaaccattgtggaagacaatgtggtgattcctcaaggatctagaaccagatatatcatttgacccaggaatccctttactgggtatatacccacaggattataaatcattctactataaagacacatgcacatgtatgtttacgcagcagtattcacaatagcaaagacttgggaccaaaaaaatgctcatcaatgacagactggataaagaaaatgtgaaacatatacaccatggaatactatgcaaccataaaaaggattagttcatgtccttcctggggacacagatgaagtgggaaaccatcattctcagcaaaaatacacaggaacagaaaaacaaatatcgcatgttctcactcataagtgggagttgaaaaacgagaacacatggacacaggcaggggaacatcacacactggggcctgtttggggtggggagctaaataaatataaatataatttaaatatatacataaatataatataaaatgttatgactaaattctttgttaaataaaaagtgaatgaacaagtaaacaaatgaatcaataaaggtagatcagtaagattggacctgttacgtttctgatacacttctgtcagcatctatgccaagctttgcctaatcaccttaagctcccaatggtcccaatttctttattcttgacaaatgaactcatttctactttattgaaaccatcagtgaccatctataaagagctcctttatgtacctataaatcatcctagctcacattttcctacatttgaaatcacccattcttgaattttcagtgcccattgtccagactaacttttccactagaactttaaattcaatcaattccttttatctctagcatcaaatattctctatcagctttaagctgttaatcctctgtggttcctcctgtactaatgcagactcatgctagtccattccaaaagacctccttgatatggctactattacatagtccttcctttattaaaaatatttcatctctaactccctattgtaacaatgtgttgttatgctttaagtttcttcctaaaatttttcattaataacctactaagaaataaaatatactaacttatagtattctgtgactaagatatctaaagtttggtttgatagtccatttaaggagtagattttcccatctctctctttgggaaaaggaacctagccaagcccagatttgtgtgtctatgtgaatcagtaacacttcaggaaggaagtatgacatagtggttaaggtcacaatctctaaaatcagacaaagtatattcaaatgtcaatcttagcagttattaggtatgtaaagttgaagaatttcattacatcttctgatacaattttctcatctgcaaaagtgtgtattggtagtataggcattatatttttgtgaaaattaaataaaacaataaatacaaagtaatatttttagtgttaggctcacagtaaagtgttactatgtattattgtcatttcactgtggctcttatttctgaaggacaggacagtctactaaatgtattgtaatgtaatgaaaataactaagccatgttattctattattttgaaaagtatctctggtttttcattcattaaaaaacatgcctctcttttggggacactccattgtccttttcttctagtcacattgaagtctgtttgcctttgaaggcagccacattaactcactgtctacagggaaaaatcgcacccctttttatgggaggaagtacagatttttgattcctgagtcctgttaatacaagtagcacctcagactttacctagattgatatccctctttctccatttctcagcttgcaaaatggagtgggcaattgtttaaggggaaaagtgtatgtgctttcaaattccagttcacttctcattagtgaaaactgtggattggtgaatacaattaatctcctgaattatactttgcaaaaacaaccaacactttttcttagacacaatacaatgcaatttcatactaaagaaagaatgttacctattagcataatcatgcccattattttaataacaataaatggatattcattatccatttttgtgctgagaatcatttggtgttttattcctttcctatagacctgaaggtatcaaaatgctacagcagtagtaaatagtaatctttgttgttagagaaagaggcaatggttttgattacattctggtttgaggtaatctgattgtgatagcatgtttggtgagaaatttgtgatcaatttctttctaacattattatttactgtaatatttttaaaatctatcaacctgtccttttaaggcttctataacatgaacctatcctgaatatttttgtttctgtctaatgctttatttcttttcttgatttttaactttccatctaaaccattactttttctcaaaatagtgtaaaccatcatctctatgtaaatgagtatactaaaaatacatcataatacctatcctgagatccagtctcaaatttccaacttttttctggccattttcattttttactttgttttatgtataaagaaaacaaacaaaaactagcaaaaacataaaactggctccagctcttatgccaggtgctatgagtaaaggacaaagttcctgactcaagtttctcctatttatgtcaaaggtactattgtcaaactgatcaaaaatttgtggtcacagacattgtcattaccttggtttgcctatgcctactcatatacttaaattctttttttcaatgatttctcaaatttatttctactttctttaccttctgtgacccttacacttaaaaggtgaaagtggaagacagtcttttgatttttttttttgaatgcacaaaatacatgttattccctgactctccttttgatggatagcccttttttgagcaatttaaaatcattttctttttttgattatttatgaataaagttcaaattctcacatctaatattctaaatccttcataatttgtcccaacatttacttctaattgtatattcaaatattctgaaacaatcacattattctaatgtatgcattctatacttctgaatgttttctatgcttatcaccaaatttgcacttgtcttttgaataatccataatgcacttttcctcttccccatattgttgaagagtatcacataataggaagctctattaacctttctttgatcatcatggtccacgatggcatctccctccttagaagatccccaatatatattgcatagcacttttctgaaagttacttttttgtgtttatgtttcttatgttcagacttggatattaagtgacctgaagataaaagatctgtattctacatcttctgttcacacatagcacttactgaggaactatacacatagcaattctataaagtagggagtgttttctagaaaagaagtgactatgtgttgatacgtctccttcaattttattaataaactttcatttacgaatatgtattaaaagtgtctttaggctctctttgtatgtttgacccatttcgtggtaaatgtgaacagtggaacaagatagttgcagtgctaaacttagactaaagggaagaggaactcaggttctaggccagccctttagagtgaaccacaaaccactttcaccttcctcccatgggggctgggaaggagagtagaaggggaagtggcgatgagtccacaaaacaagtgaatgtgctcatgtgaaacaagactcatgcccatccatgtgctatgccaatgtaccaatactcaagactctggattcctctttaggagaaataaaaggtcctaagattgctttcaaggtctattcaaggccattccctacatcagcctttttgaaggtggactggtgtgtacaacccttggtcaaagggatgtctcatgaggagatgctggacaaataggctgcagtatcttggatgtaacaaacccctcatccagcaagatggaaagaggggtggaaagagaatgaaattggctatgacctggggcctctttccaatcctcacattccattgtggacctctcttggcagtccaagaatgcagatttcaatttaattttttaagttgttatgaagttgtcaatgtaggaatttcaatacactttaacagttcttaagcttgattgatgtcttataaatatgtagtcattaatatgtgggtctagatttgcaatacttctgaacttccacaaatgttagggacaggcctgaatagctaacttttttcttttatttcaagttgacttaatattataaaaaacattttattttttcctttaatagagtcaagtatacagtttctgttttcatccagtaactttagcagagactttttctctctgctagtgaaagagaggactcaggtttagaggaaatttgctttttcagaacatttgatcttcgtaacacatcaagatgtatttagagaaaagaacacacggacttagtactatttataaatagcttctttacccttactcctaaattaaaacaaaactaaaacctaggaaaagcacttgcattatacaaaatttatactttagctatttctacatttaaaaataaaataatataaatcaccaattttacgttttaagcaaaagtgtattctcaaactttatattattcagcaatacctattactctccaagtatatgcatgtatcatttctctcatttaaagtctctgaccacatctagaaaaagtgaaaaatggtgcagtcattacattttggttttggaactgggaattttatttagcacaatataaataattagggagtaattccttttatactatttttcatccactttttttttttttttttttttttgagacggagtcttgctctgtcgcccaggctggagtgcagtggcgcgatctccgcttactgcaagctctgcctcccgcgttcacgccattctcctgcctcagcctccagagtagctgggattacaggtgcccgccaccaggcctggctatttttttgtatttttagtagagccggggtttcaacatgttagccacgatggtctcaatctcctgacctcgtgatccgcccgcctcggcctcccaaaattctgggattacaggcgtgagccaccgcgcctggcctcttttttttgtttgttttttttaaccatttctgatttactgaaacccagtctgtatttaataaggcttaaacatttgtatgtttaatataacaatatgtcctcagtggcagcttgattagatttggattttaaaagtcactgtagaagggaggaaaaatatcaaagaagggatacatactggtgacaaatacttttaaaatagcataactcaagtaacgcaagtcagtctcgccagccaaatgaaaattataggtggaaatctcacactgaacctggagaatttcccgttcctgttaaagtattttcttactgatgtattcataaaacaatactgtccatttatgtctttcagaaaccattctattattttcattaacatacctgtatattagaataaaaactttacaaggttatgttttcattttccacttttttttcttgtttctgtattactttttatatcagtttaattttggcatttaacctagctatctaataccttggcagtaaacacatttcccacccttgctcttgaatataatgctgtcagagagtgggatatgagaaaagcaagaggttttctaaaaggaaaatatctatctatctatctatcatctatctatctatctatctatcatcaggaggacctagagacattataaaagaattaaattcaaattgtaagatcataataaagtttaacacatcatgatttataaactacagatataaactaagtaacttgtttaaagctccaggtgctgctttccataatattttaagtgaaatactgtgtgtataacttaaaaccattaggccatgaagaccatggagaatattttaagaatcagtcacaatctgaagtgacattattgttttttgtttcagtacacattagtaccaatagttaattttaatttgtggaatgaatcagtaaacaataaaagggtatgaaagggtaaagcacaatttaaagtgttttggaaaatgtggtcagaaaacaacataagatcagtagaataattctagcatatccatcgaataattaatattatcactatagtaaacatgatttagctcacactatttggcgaaaagaaaattcacttgcagtattctgcacattgtgttatttctgctcaaatgacatacttacaataatttgattgaaatcatgtgactctcctgaacaatcatgttctatcttctggtttaaggctatgtagatattaagagacatacagtgatccatcttctttgtgtggaaacgatcaaacactacaagtcagttaatgtgttttcaatggtgaggggttaataccaaaagatttatattagaattgtatagcatctatatttctaatccttagttatttgtatgaacaattagaagtctgacctgtttggaacttattttggggtaaataggttcccaagccttcttgcaaaggacatgcaaataatgaaaatatgatattaagaaccactccactgttattaaatgaagatgaaaagaattaaatcaaagtctgccatagaataatttatagataccatattgaacattttctaaatatgcccacattcttggagtggcagataatgtgttaacattataataagcatgagttaataaacattatgcatattctctactacagatgagtatactttttggcccttttaatgaaggatgggaaataagcaactccctgtaagaagaagaacagaaatggatccatttttgacttgaaacttttataaaaatagctgtatttaataatgttttacttatcatgggtacattttttttaacttgtgttcataaggtagattcattcagcaaaagagtaaccggtactagaagagaagtaagaaattcatggctgagttaatatagttaaactatatccgtctgaaactctttctctctgaggaagcttttaaaattatttttttcatttttccagaccttttttcttgatctctgtattttcctctaaagcgaagactatcaatgacattcttaaactttgaaagatttaggatgaagggaatatttacttatattttagaaatagtgcaattttggagactgagaagtctctcaggttattatcatcaatgtagaacttaccagagatgactttggctttctaaagcatctaaaataagctatagtatgcccatgttcctgcagcattggacttacataatttcaaatgttaataatacctttcatggatgcctttacaggtatgcataaacaaaatatctcatttttttaaatcattctgccctccatatgaaactattggtctattagatatatttttattttttaactgttgatttgaaattattatagatttacagaaggttgcaaatatagtacagagaggtctctcatactcttcacctagtttccccagtggttacattttttttgtagctacagtaaaacattaaaaccaagaaattgatattgaaaaaatgtgtatgcatacatctgtcattttattacatgtgtaaattcttgtgaccactaccactatcaaaatatctaacacttctagtgaagtgtaaaaatcttatctcgttggaagtctctttacccatccttgtttatataattttaaaaatttttcatttaggtattgataaccatttcgatgttacagtttttgattcaaaagtcaaacataatttagaaaactcaagaagaaaaatctgttgtacttattcatatttttgctctttctgttactcttacatttttctgatgatttcaggccccttattcattttatgtttcaagaactttttgcttttctttagggtaggtctgtttgcaaccaattcttaatttttcttcttctgagaatttatttaattctccttcatttctaaaggacatttttgcctaatacagaattctggtttgacagttcttgttttgcagtacttgaaaaatatatcacttccttttggccaccattatttctgacaggaaatcattgtcattcaaattgtttttcttctggagagatgaagcattgttttacctcactgtttccaagattttttcttctgctgttttctgaaattgacctgtttctttgttgatttttttgtatctgtcccgttttagattttctcatttcttgaatctgtagttgtatgtcttttgccaaactcgaaaacgttttggacattattttttcaaatatatttttagcccaacccacttttgcctttccttctaggactctgatgacatgaatagtagattttttgctatagtcttataggtccttgaggctctgttctttttttttttttcaatttcagtctatactccctctggtctttggattagtaaatttttaatgtcctattttcaagttcacttattcttttctctatttcctccattaccctattgagccatcaagtattttttaaagtttcaattatatttttcggtgccaaaatttctatttgtctcttggcatcttctatttctttgtaaagctttccattgtttcatttgttccagcatattcgcaattgctcattaaaacatttttatggtggtggctttaaaatccttgtgaataaatctaatttatgtgttatcactgtgttggcatgtgttatctcattcaagatgagattttttttctggtgcttgatatgctgagtaattttcaacgtatctagggtaatttggatattatgctatgaggctctgtattttaactcttggaaataaacctcctgtgacaccacacatggtgaaagtgggggtgccttgttattgctaggtggtgataaaaatttatccctgctcaaccacctttggagagtgggggatttttttcttgtttctgctcccactatggcctacactgaagggaaggcaaacatcaggaggccttggacctttttaccactagatgatggtgaaagttccaacttctcacttagtttactttgacacctaaggaatctggtggagaaggacggggcacattgtaactacctggcagagaagaaagttctagattcccacacggccttctctgatatcacccagacattgataggcggcagggcctgttagtttgtgtgtgtgtttaaattacacattaccaatagtatcactttgcataaacctatactaaactaaaagcacggaccccacagaagatatgtaattaaagttatcttgtagtatgcaggtctttttcacagatgcattcagtgtgtggtttaaaaggaagttaaaagtttagttctagttaccatgctagaagaacctaataggtaaaggatgacatcatcaaaggcagtgaaagtcctctttaatgtctcaaggcttttcattgtgtatcacgaaattttggttatctgtttcttttcagtaaatatttagtctatttttctaagtttaatatattaggattttcattttcattaatccttagtgtttgtactactgatatttgcacatacagtatgagaacatacatttcaattgatcatttttaaaaaatttatttgagatatatcaaaagttctataccatataaaggaaagttattctactattctaaagcagctcataaaatacaatgtacaaataggacaaaatacatgcaagaagcgggagaaatgttcctaagcagctccactgatacagtggagatataatctctcctctctattgaatgaatttgctgagggtcggtgcatatagtagtcaatggaatacaaaccaataaaaatatgatagataaatagaatgaaaagtatccaagggtcaagtgctaaatctgttctgctgattccagctggtatttccttttcttctttaacccacatgaagacactctactaaacagtcatgtataactcaggcatactggttttcatttgtaattttcattttattgcactttcaattttcaggttttgtccatctttcttccccttggcccttccatcacttctgctacttgatgaattctgtcttaaacagtagctagaatataaacatttaataaaatattaacctgattgcttgccctccctataaacaataaaatgacatacatgaacaaatgacaaatacaatattttatgttgtgtttatttctacctttctccaaggcttcttttaatctttattaaagtttattatagcaaactactatcaaatatttccatgcatttaactggttattgtaacatcaacacaagagagcaaatgaaattgtgaagcttgtactttctattgctctaaggtgtctatgcagatcattatgtattcttcaccacaggtcagttgcttagctaccagagaagtagagaactactaattgaaagtattctgtattgctggcaaggcttgctgcaggacgttgaacttggaaacagcagagactgtgtcagataaaaatgttgcagaggatgaaagaaaaatagttgcagcattatcatactaggaatggttattatttactttatggtaaattctgcaaaatgctttgctgtgcttctgttttgtaagatattaaaattgattttactattaaggatcatttacacaatcagattaaaaatcagagttgtggcatctatttttaaaaagtaaaacagaacacaaaggagaaaaagaagaggaggacaaaagggaagaaacagaagcaacagcactaagttagatccaggtccctaaagacaagtaacaatatctgtatgaacttttctgattgcttattttattttgtaatgaaaacaaagaaagaggatgaggaggaagatgaggatgaggagactgaggaggaaggcaaggagagtaaggaagaggagcaagaggtaaaggagaagaaaagaaaaaagagagagagaagattattaaaaatcaaactaaatacatattggaaaaacaattgaaaaacaaaccaaaagtagcaacactaacagagcaatagtataaacaaatttattcaaagcattaattttatattagtctgtatcaggctttctaacctgtacattatataaaattaggattattttctctcttctttccatgtaatgtacaattcatgtatccatcaaaaatagatgagtggtcattgtgtgacatctttcacttaatagaaaagactaggtcagaaaagagaaaatgtccttcacaagaccaagactaagttggctcaattttcctgatagcttatttgctacaagaattctgatataattctgtatttacaggctcattctctctctcacacaatccacaggcatacaaagtgtgtgtgtgtgtgtgtgtgtgtgcacatgcgtttgacaaagagagagagaaaaagacttgaataactgtttcttatgagaattcatttgtggtaatggttgctacttgtatttctataaagattactcctagtaatgattgaaaaacaggacatatgttaattaaatgttcagtgactttatagttaaatatacatataatgcacattccaagtttttaaaaaaataacaatcaataaatagctaaatgttttaaatcataactggtcagaatttagttgttaatattcagataccatttcagtatcgtgtagagtcattatgaatatcatttgtctgcagtactctgaagataaaggtggtaaaacatgtgttagtcaatggtctacctgttatacagccttttaaaacaaatccttggcatgagattgtcatttgtctgtttctcataaaagctgagtgtagaacatcctaaaaatccagttcagcttttttattcttgttacatttctgcagaattttaatataactttccttttgtgtatttatgcctactgtttctatttacttacgggtggcctgaattttttatccagagataaagttaatgcaagaaagaatttaaaaatgtatggtagattatcaaaattcttaacttaaaaaaaggtcaaatccacctttgctacagcacacaacctaatcttatatctgttcatcttttttgtctttgttttaaaaacacatacttgataatcatattagatggttacagctttctattgctgcataataaaccagtctaaacatagcagcttaaaacagctaagtagcacagatggacctgctcatgattcttcaatctgggctgaactcagctgggtggctcatctcttccctagatggtgtcttctgctggactatttaatatgtttgtatttagaggcagctccatagggactggaggatcctagctggccccattcatatgttgtgctggaatgactagaaactaactgggtcttcctctctatcttcccagtctttcattcctcctggtctttttcatcataaggtgtctcatccacaaggacgctaacctagacatctttgcacagtggctcaaggtaaaagacagagtaaacaaaagctataaagcttccttaagcctaggactgaaacttatacagtgtctctttagctgcattctcatggctcaactaattcacaaggctaatctattgtctggttgggaggataatgcaaggacatgaaatcaaaggacatccataattcattggggactgtttggtaagaatatgagttaaggcttaaatttgttcgaacacaactggttctaaagcatcacattgttgtattaggtttccagggttgtcataacaaattacaacaaacttgatgacttaaagcaacagaaattgattctctcacaggtctggaggccagaagacaaatgaatgtgttggcagtattggtttccactggagacccagaaaaaacccattccatgctgtcagcaattcttagcggtttttgtctttccagtctctctgactctgtcttcacatgcctccccgctttttctgtgtctttctgttattctatctcttataaggacactcattagatttagaatttattgtaatagaggatgagcacactttattaccttattacatcttcaaagatgcttattacgattgaggtcagactgtgagattctgggtggacaaaccttttgggcaaacaccattcaactcttacgattttctatcaaaatgtataattttctcccatactttttcagtaatctccaccataaagaacttggatttagaacacttggattcagtaatctccatcataaagaacttggatttagaacactttttttccacatgtatttaagcaatatttctcaaagtatattcctgagaaaagtatttcagttattctatgagtaaaaagtttcttggtcatgcaattttggaaattactgcttactattaacacctcctggatatttgctttgtgcattaatttattaatgagaaatcatataggaaaatatgctaaaattttaggaagcacatgtttttcccaaacaccaataaacactaaatatcaccaattttattcaaatgatacctatcaacaccttacagaaaaagggttatgtgtaccaaaggtcctgatttgacctattgtgttgactacatgatatctgtttcaaaaatataaacaaaattaccatgagtattactaaacattttagtaatctgtgcccttgcaattcagcaagccatttcaactacctggaattttctttctcctttttatggataactcctactggtcctttagatatgagattagaggttattttccaaagaaagcttttcttcactccccaaagattcagttagttgttcttccagtgatttttatagctctctgttcttggtggtaatatatcactgaaacactctactgtaattaccttggtttttgttctttatttagtgttcaaccatatgcttgctgaagtttaggatgttattcgtcattgatttttaagacacaacagatatttaatcaattcttattaaatgaatagatgagaaaatttgacattgggtagaaatcctttaaaatattttgcatggaaatcactttttgctttcaaagtaatgtaattaaagacttttagttcccacagtttgcaacaataatcttaggaacttaactatttgttttgtgaatatctagcactaaacaatgagctagaaatttgataaaacagttcaaataatttttaaatctctttgactcaactagtcatgactgaattcatttataccattaggatattaacacgtcttttaaaaaacagtgttaaatggagctggtcaagctatgcattttaagaagaaaaagtactctctttttaataggctctgcataagtaaggctatcctctttttcatagtttttcagaaacaataactttgtcattttctatacttattgataatttccccaacatattaacaattaagaaataaagttatggcagcctaattagtcgagtcaatacaggaagtaaattgttaagacagtgggcataccatcttagttagtaagatatggacattcaaccactctctttccctaccctaagacacacacactgtcagagaaaatgttatgatgtgactgagaactttatgctcaaagctttccaaaatttcatatataaatattgtacttttatcaatataagatttcacactgtaagaaaacattggcataggaatcattctcttttacacagtttgaaaatgaattttaatgacacttatatctgataaataatataatgtcatggagtaaaagttattttcttgatataaatattttatcatttgagtatattctccctgaaatctaggtgtcagtttaacaaaatgcatttctcacttcactgaatatgactccaggataaataaaaaagaacattcatattcaaaaaaagtaatttatttacctagtttatcccaagatttatactgtcaatgccttcattacaaattaagggctaaaatatatagtaagttcctgaagctctaccaaatgttatctatactaagtagaactaaattaaatcattgtgttaactttttattcctattaaaggatttagtcttcttctagtttagctataataacaaaagcaaatgtacatccctggtttcttgccaattatagcttggtcacacctgcctaagtagtgttttataataaatacatggtaagtaaattagtatccaaccctcaggcctacatggaataaatttggtggggtacttctcccttgggaaaaaaaatgttgttagcattttttgtttgctagtatcctttagacctactacctataaaaacccctctaaatgaagactccggcagcatttcaataagctaacttccataggtttcttcagttcatgggggtattttcctcctttaatttgccagcagagatctgacatgaaaaagttcaggtgctgttttataatataagaaaacatatacatgagactccttgttccttgtcataatcacatgtacagtgctttaatttcaacaaatcatatagaaaaaagaaggttggtttaagtcatcatcacaaataaaaaagcccataaacctacacctatattgtggtcttgtaattcaccacttgtaagcttgtaaaacctaaaacttaatatgcctacaaattttgaattttttagaatatactcaatttgcttctacttcttccattggggttcatggctatcttacattgtaagacagttagtagacccagcagaaatgacttcaaaatatttctggtttctgtgaaagtttgaaaatctgttgactccctggttgttctgtttggaagccttttacgcgttgctttccctttcttatttctccttacacacatacaagctcttttcttgcctattgtgtgtacttggctgatcttctgggcacagtgcccagttggtttaatgtgtgcttattattgtctatagcattcctgattctgttttggagataggtattctatgaattattaatgattattatcatcctttagaatcaactttgcttttggaatttagaaacaaaagatgaacattgagccctatgggtaatcaccagcaatatcaaggccatgtccaatgcttgactgtaagggaaaggaatagtgaatatactgaagtgaacaaaacaggattactcctataaacagataaaattaacagaagaaaacttaaagttcaaaatgtattacttgaaaaaatgctcgtaatattattttaccatacccattttaccatttaaatattaccagtagtttttttcctcaatatccattgataagcttattctttaaaaacagaagtggggaaagtgctagcttttttgcttcttattcacaggaacttgtgcacctgatgtagtatagcacattctcaaacatctaataggtcacttctgaatttttctctgaattttgaataagataaaagtaatttgaatttagctatcatttcaaagaagaaaaaagttgcatttgcaaattatttacacaagcacaaatttttagagaaagaaatactagagaaagaaaaacatagaggaaaataggtggtgaaaaaattctttggaagtgcaaaagaaagaaaacgtttattggcaatgacacatgattattaatccccatgtctaagtaaatttggggtctttacccttgctatagtttggacatgggttattctctccaaaattcatgtcgaaatttaatttcccatgtaaggtgttaggagatcgtgctttgaagaggtgattaggtcattaagacaaattaataaatttctggtgaaactgggttatttttcatgataatggattagttctcataagagccggtcattctaaagaaagttgcctcttttataaagcaatgatttgcctgatttccattttgtttctctgccttgctgtgacatagcatgtggctctcatcagaagctcaacagatgccaatgccatagtcttggactttccagccaccagaaccataagctaaataaacctttttttctttataaattacccagtctcaggtgttgttacagcaacacaacacagaccaagacaacactacacctgtaatacgtaatattttgaaattagattttagcttaggaacaatacatacccaataaagtggagctcagaagacatcacttaagaattgttaaataagtgccatctttttgtttttatactgaaaaacaaatgtatcgattctcaattattttctccctaatgtaacaataataacataatattgtattttccaaaaccattcctcctttctctcaattgtatgtatttttccttttttctttctcctttttctttttggagtatgataaatatttttaaatctatcctcctgaaattgcatctaggatttggatatattttgctataaatctttgcttccttggaataaaaatattctctacatttttattattctaatgttgattcagctttggagttaatttatatgcaaagcaaataatttacccaaacttgtaaaggatatgcattatcagaacacaacacctgcaggatttcacatcacgactatctgttccattacttcctccatgttaatgaattcaagtcttgattttctccaaagaaaatggggcaatgaaaattgcatttcctaaaattctccttgaattatgttttaacatttcaagtgtgttaatgtaatgctttagaagctaaagggaatgattatataggaagctaaagtcatctatgtctatcctcgggattgattaagtttgctatttatacatgtttcccccacaacattgctgtgttggaatttatcaggataggaaccatctaaattgaaaatgccccttcgtatatttttatcacagtgaaagtcaaagcctagaataacagaaaggcacaaaattaatatcatcaggaaacaatttactcagctaattagcataacattctcatataaaaagacagatggattaagggatcaggtcattcatagcctgcagcaaactgcttcagtctttaatcccctgctgttacctatcaaatggtactctttttatggatttggacagatccctgggaagatttagattctcccattggactgattcaccttgttcctttaactttttattgatgatatatttcattatttcctgactaaaacaacagtaagaactctaaattagttagcagctaaagaattgaactaaaggcgtatctccacatttctcatatagtagcttctaccacacacacacacacacacacacacacacacgatgccctgcagtgctaacaaataggctccggcttgaagacaaccatagaagagttatatatatatatatcctacttcaataaaaattgggatttcatgctacatacgcaacattcaagacaattaggaatagcacagtaacagccagtagtaactatgaaaaatatcaaattctttacatggaagtagtcaatcagcatagattatagatttccatgagtcctttaaaaatgtttccaaaaataatgtctaagaaaactattagtgaagatgtttgatctattgtatagaaaccaaaaccaacaaatgaaagaaaaggcctctgggaaaaaaaaattattttaaagttttaggctacagggagataatttatttccctttgactattgtattagctttctagggctgccataacaaagtatcacaatataggtggcttaaaaaaaaaaaacaaacatttgttgtctcacagctctgtaagctagaagcctgaaatcaaggtgttggcaagattggttccttctgaaaagttctgacttaaagtccgttccacatgtgtcttctagtttctggtggttgccagcaatttttggtgttccttgacttgtgcatgcatcaccccactgtctgcctctgtcattacatggccttcttccttatatttctttatgtctctctgtgtccatattttctttctttataaagaaaccagtcattgaattagggcccatcccatttcaatatgaccctgtttcaaaataacatctgcaataacctatttccaaataaggtcacattcacaagtattgggattagtatttcattttggagactcgattcaacacacaatgactataaacaatcagaatgttagtttattaatttataacaagaactatgttatataaaataaaattcttacttcagcataaacagtacatactttccacccaaacgcacatctgtatgggaaaacaaaatgtagtcacatgatagctgggtatgtattagatcagaaaaataaagttcaatgattagaatatttaacaccatcaagctaatataaatgtgcacatgcatttatttttattgtaggaaggcttaccaacttaactggcaatttcacttgcccagacttcctgcctcaggaattggacttccacttaggtggaaaagagatttatgccttaaagattcatctgtagctcagtttccataggcaactaattctcctttcattgacagactctttctataactatgttaataaattcagttccaacatagtaaaatcctctgactttaccccgcttaggttagtttacagtgcttcagaaggcattctttctactcttagttttatatatttataaagggttatataaaactaagagggttgtatttttgtagccatctttctgattatccccatgtactgagaatatgtgtgtgtgtgtgtattgatacattttatttagatgtgtgtgtatatatatatatatatatatgcaagactatatgtatatagtcttgtcctatttggaggcccattaaagtattttttcttcccattcttttacttcaactatgatatacaattaattctgttatacacacacacatacacatacatatacacatacatatatatgtacgtgtgtgtatacatatgttttaataatcaaagttacaatttattttgaacatattatttgccagaatttatatggcatactttgaattcactaacctatttaatctttaatatctaaatgggataattattattatttatttttcaaagatggagtaacaaaggcttctgttacccctcaatgttgcccattctctacagactgtataatagaagttaaaattatttttgcccaacatcaaatatcttgcatcatactgcattcctttcagcaacctgcatttttcagcatcctgcaatttccctataacctggaaattttgaacctccatgtcttcgtgtgtaatattttctgcatgaaaaatgtgtcatttcaacttatctaactcttgcttactatctaaggtaaggtagaagtgccaactttttcaaggttttagataaaaggtgaaaataatagtctcttggtccacactcacatagccctttgtttatattaaacactatattatattatgctatattaatagtcagctgtttattcatctccttcagcagactctaaaggccattagggacttgctaattcatttactaattaattaaagaaatttgaggagaatatcaagaataaccctctacttgttcccggccaccattcatcactcactttcttaattgttcattcacagtgtacatatacggtgatgtcagaaacgttacatcatacttccatgagaaacaactttattaactggagcactgtgcttgtatacacttcctttcacctttaattttacagtctcctctcatttctgaaattacttatttcaacgcattttttcccacccatctcagtgaggttgtttcatatattttcaatacagttataatattttgtcacactctgcattccatcttgcaatccctctacttcctaaaggatagttttttttaaaattatataaattaatgtttcctcctcaagctcaaaaactcttatggattttgagaaatgcataatgttatgtccaccattacaatatcatataaaatagtttcagtacagtaaaaaatttgttttcatgtttcacatatttaaccctacttcctctcctctcacctctggaagcactaatcttttatactatattgttttgccttttttaccatgtcatatatttagcaatatataatacgaggcatttgctgaccaatttctttcacagagcaataaatattgaatattcatgtatttattcctgtagatttatatttatttcttttttctggatgtaccagtatatcaattcacttacttaaggtttaaggccatgtaggttgctgtccatttttgataattataaaaaagaactctgataaacactcacatttttatgtgatataaattgtcacatcattgggataaatacttagaagaatgatagctgaagtacgtggtgagacgatatttagatttgtaagaaactgccaatctgtcttccagcgtgcagtaccatttttaaaattcccttcagcaaacagctactattgctctacattttcaccagaatttgtaatacttcggttcatggatttaagccattttaactaatgtgtggtagtatcacaattgttttaatttgtgtttctctaaagaaaaaaaatactgagcatatttttatatgccagttgccatgggtatttcgggggcaggggtgaggtgtcttttcagattctatgcacatttgtaattggcttgtttgctttcttattattcagttttcagagttatttgtatgtttagataccaatactttattagatatatggtttacagatattttcttctagtttgtggcttgtcttttaactctctggagtctttcacagagcagaaaattccattttaaatttaacaaactctaacatcattttttcttttgtagctagaacttttcgtattaatattatatctaaaaatccattatcaaacctaatgtcactcattacatgtaaagcatgctttctttttcaactattctagtggttccccagagtatccaatacacatttgttactaatctaagatcaccttcaaatagcactccaccagttcacatatagtgcaggtaccttaataagaagttacagcgtgctggcagcccttgctcgctctccgtgtctcctcggcctggacgtccaccctggccgcgcttgaggagcccttcgccccaccgctgcactgtgggagcccgtctgtgggctggccaaggccggagcatgctccctctgcttgcggggaggtgtggagggagaggcacaggcgggaactgaggctgcgcgcggcacacgcgggggcggccctgcactcagagcggtcagactggtgccacaggccctgggcagtgaggggcttagcacccagggccagccgctgcggagtatgcgctgagttccgcatcactgccagcccgcccgctctaggctcgaattcttgccaggcctcagccgcctcgctgtggggcagggcccgggacctgcagcccgccatgcccgagcctttccccgcccgcgccttcccccgtgggctcccagcggccagcgggagtctccccaacggcactgccccctgcttcgtggcgcctggtcccatcaaccacccaagggctgactagtgcaggcacctggcgtgggactggcgggcagctcccccagcggccccagcgcaggatctgctaggcaagccagctgggctccccagtgaggtggggtcttggagaacttttgtgtctagctggaggattgtatatgcgccaatcagcactctgtgtctagctcaaggtttgtaaatgcaccaatcagcaccctgtcaaaacaggccaatcagctctctgcaaaatggaccaatcagcaggatgtgggtggggtcaggtgagggaataaaagcaggctgccacaagggacagtgataaccggcttgggtccgtttccgtggtgtggagggtttgtgtttttgctgtttgcagtaaatcttgctgcacactctttgggtccacactgcctttatgagctgtgacaaccaccgggaaggtctgcagcttcactcctgaggccggtgagaccaggaacccactgagaggaatgaataactccagacgtgctgccttaagagctgtaacactcaccgcgaaggtctgcagcttcactcctgaagccagcaagaccacaaacccaccagaaggaagaaactccgaacacgtctgaacgtcagaacaaattccggacacaccatctttaagaactgtaacactcaccactagggtctgcagcttcattcttgaagtcagtgagaccaagaacccaccaattctggacacgttaatagaatagtcccagttcatccttcatatcttttgtaacataaccatcaggcatttcacttacccacatgctgtaattgcccaaaacatttactaatattactttaaacaaacatgtagtttaaaaagatttacaataagaaaaataaaaaattttttttcctttttcaacatacttgctttcttattgtaaatacaggtttctgatctatatcactcttctcctccatgaataacctcttttaacacatttgcaggaaagttttctggcaatatattccgttagtgttttattgtctggtaaattctgatttcccctctgcttttgaagtataattttgctagatgtagaattctaagttggtgcatttattcctaaacatttcccgcaactctcttctttcttgcctggtttcttactggaagtgggctgaaatccttgctcttttttctctacaaggaatgtagttttcattccagattctgtcaagattttctctttgtctatttattgatttattttattttattttattctacatataggaaatgctatgtctggtgctgtatttttgttgtttgtcatgaattgtattctctgagcttcccggaccggttgtttgtttcatgtcattatgttttaaaatttcttgaccattactcatttagatagattctcctcatttctctctttcttgtctttctgctattccagtttcccattttgtacaactttagaaactgcccagcgggtctttgatgtccttcactttttttttccgtttattttttcttggcactttgttttaaaatgtatttttgacctatctttagtttcaccaattctttccccaaacatgtctggtctactaatgaaaccattgaaagcattttaaaaaaatctattggcgttattttaatttctagccttttattttggttctttgttagaattttcatctctctgcttatactaatcatcttttattgaatattttctacattttccactagtgtccttaacatcttaatcatagttatgtaaatttcttgattgctatttccaaaatatgcatcatcatcactgagtcttgttctgatgatcatcctgtctcttcagattgttaatttttttcttgccttttaccatgttttgtaattttgttgccattgttgagagctagacatgtggtatccataatagatattgagataaattgatgctgagataaattgatactgagataaagttaattgaggatatatgttaatctgtcttggagttgaactgcatttaatatttgttatagctcaagtttctgaaggtttcaaattcctctagtgtccttgtttttgtctcctcccttaactttaggtttccttaagtactcatcttcaaacagtgtctgtttcttatagctcttttgtctgtctccttatattggagtcatgttggtttaaattttatggtatgagcagagaaatatgttctacagtgctctgattgaatatccgcctttcagtgggcctatgtcttaggttatgacttttacgagtgttttgccagtagtttatcttttgtccctattacaggactgccagattcatatgcccactgagcagcaatagaccaatacactgagacatcataatttgcagcagaaaaagagtttaataatcacaatgccattgggcaaagagatgaaggaatcctcaagcttcacatctgtctgcttgaggggttctgggccagggtttttaaggggattgtggcgggtgaggttctggagaattggggttgtcaattgctcaggtcaaggaagattaaatcatcatgatgtgaaaactgcattcttctgtgagtcggctccttgctgggaccttcagatcaactggcatcaacaattttatcagtatgcgtaacataaaggagaaactcaaacagaaagcatatcatctcatgtgccttagatcttatctatagaaaagaaaaggaacacattcttgtgacaagggctacactatcttgggggagtaagaagtaactagctacaaggaagtaggccaaattgggaagtggatttcatgattgccactgattattctgcaagcctagttgaattttattttctcccttaattggtttataaacttttctttgggacagtttcatcctttatcccctttagatgagaaaagaaggttaaatgaggaggtgccaagatggccaattagaagcagctgtggtctgtgactcccatctagaagaacaaaaatggcgagtgaattctgcaccttcatctgaggtatccagattctctcactgggagtgacaaggtgattggcctgacccacagggagcaaggaaaagcagggtggagcaatgcctcacttgggagctgcatggggcaaggggcactcccacccccagtcaagggaggcagtgagtgattgtgctccctttcctgaggaaccatgctttttccatggatctgtgcaactcacagatcaagagatccccttgtgagtccacaccaccagggccttgggtgccaagcacagagctgtgcagactctcatcaccgctcaggctgtggccagtgacagcagactggagactgtctaagatgactgagttcccaggggaaggggtggttgctatcactgtggcatcagttggctgttttcccctggtggtgctggggagacagggaggtttagaccgggagcacagcagctgtggcagatcatggccagactgcttttttaggtggaacctggatccatccctactcattgggtggggcccccttgtgggaatttcaccaactccagccagaggtttatggacagaactctgatcttcctgggcagaactcctgtggggagggacagccacagtctctgcggttcagcagacttagtctttcctgcctgctggctctgaagggtctggacattctggacaagggagattccctccagtgcagtgcaccctctctgccaaggggcagccagagtgctttgttaagtggtccccgatcctgtacatactccctaactgattgagaccaccaacaggggtctccaggcaccttatacaggagtgttcctgctggcatcacatcagtgcccctctgggatggagctcaaaaaagaaggagcaggcagccatccttgctgttctgcagcttccactggtgacacctccaggtaggggagggaccaagtgaatagggtctggagtggacccccagcaaactgcggcagccctaaggaagaggggtctgactgttgaaagaaaaacaaacaaacagaaaacaacaacaacaaaaacatccacaaaaatggccccacaaaaaccccttccaaagatcagcagcctcaaagatcgaagatagataagctcatgaagatgagaaagaatcaatgcaaaaatgctgaaaactcaaaaagccagaatgcctcttctcctccaaatgattgcaacacctctccagcaagggcacagaactgggtggaggcttgaggtggatgaactgacagaagtattcttcagaaggtgggtaataacaaattttgctgagctaaagtatattctaaaacaattcaaagacgctaataaccatgaaaacattataggaactgtaaaccagaataaccagtttatagaggaacataaatgacctgatggacctgaaaaacacaacaccagaacttcacaatgcaaccacaagcataaataactgaatagaccaagcagaggaaagaatctcagagctcaaagactatcttgctggaataagacaggcagataagattagagaaaaaactgaaaaggaatgaaaaataatcagagaactatggaattatgtaaaaagaccaaacctacaactgattggggtacctgaaagaaatgaggagaatgaaaccaagttggaaaacatacttcaggaaatcattcaggagaatttccccaacccagcaagacaggccaacattcaaattcaggaaattcagaggacttcagtaagatccatgagaagatcaacccaaaacacataattgtcagtatctccaaggtcaaaatgaaggaaaattgttaagagccacgtcacctagaaaaggaagtccatcagaataacagtggactcctcagcagaaaccccataagccagaagaaattgggggctaatattcaacagtcttttttttttatactttaagttttagggtacatgtgcacattgttcaggttagttacatatgtatacatgtgccatgctggtgcgctgcacccactaactcatcatctagcattaggtatatctcccaatgctatccctcccccctccccccaccccacaacagtccccagagtgtgatattgcccttcctgtgtccatgtgatctcattgttcaattcccacctatgagtgagaatatgcagtgtttggttgtttgttcttgcgatagtttactgagaatgatgatttccaatttcatccatgtccctacaaaggacatgaactcatcattttttatggctgcatagtattccatgatgtatatgtgccacattttctgaatccagtctatcattgttggacatttgagttggttccaagtctttgctattgtgaataatgccgcaataaacatacgtgtgcatgtgtctttatagcagcatgatttatagtcctttgggtatatacccagtaatggaatggctgggtcaaatggtatttccacttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtcctccgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgctttaactcattttatgaggccagcatcattctgataccaaagccaggcagagacacaacaaaaaaagagaattttagaccaatatccttgatgaacattgatgcaaaaatcctcaataaaatactggcaaaacgaatccagcagcacatcaaaaagcttatccaccatgatcaagtgggcttcatccctgggatgcaaggctggttcaatatatgcaaatcaataaatgtaatccagcatataaacagagccaaagacaaaaaccacatgattatctcaatagatgcagaaaaagcctttgacaaaattcaacaacccttcatgctaaaaactttcaataaattaggtattgatgagatgtatttcaaaataataagagctatctatgacaaacccacagccaatatcatactgaatgggcaaaaactggaagcattccctttgaaaactggcacaagacagggatgccctctctcaccactcctattcaacatagttttggaagttctggccagggcaattaggcaggagaaggaaataaagggtattcaattaggaaaagaggaagtcaaattgtctctgtttgcagacgacatgattgtatatctagaaaaccccattgtctcagcccaaaatctccttaagctgatgagcaacttcagcaaagtctcaggatacaaaatcaatgtacaaaaatcacaagcattcttatacaccaaaaagagacaaacagagagccaaatcatgagtgaactcccattcacaactgcttcaaagagaataaaatacctaggaatccaacttacaagggatgtgaaggacctcttcaaggagaactacaaactactgctcaaagaaataaaagaggatacaaacaaatggaagaacattccatgctgatgggtaggaagaatcagtctcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacgctacctgacttcaaactatactagaaggctacagtaaccaaaacagcatggtactggtaccaaaacagatatatagatcaatggaacagaacagagccctcagaaataacgccacatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagagttaaacgttagacctaaaaccataaaaaccctagaagaaaacctaggcattaccattcaggacataggcatgggcaaggacttcatgtcaacagtcttaaagaaaagaatttccagctcagaatttcatatctggccaaactaagcttcatgagcaaagaagaaataaaatccttctcagacaagcaaatactgagggaattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatcagagtatttcttggtgcttttaagctgttaatagaatttgaagttttattgattgacttaggattatttgtaagaacagaagttgttaaaaataaggacatgtaggaagagcagagacgttctacctctaagtacagttgtcccttggcatccatggcgtattagttccagaacctctgaggataccaaaatctattaatgttcaagtcccttacataaaatggtgtagtatttgcctataacctatgcacatcctcccatatactttaaatcatctgtagattacttataatacctaatgcaatgtaagtgctgtgtaagtagttattatactgcattgataaggtaatcatgacaagaaactctaaactctactatggaaagctacacagagtcaacctgtttctcacaatgggtttctgttaccttcttaccaagctctaattcttgataaagtctgcttattttccccaaataacttttagataaaatctttattttcagtttgcataaaagttagtgcttattctgtgaatctgacccataccattattttctttttgatctgggtctctggcattggggcgatttgtaaaactatattaaagtatttgggggtaatttactaaacaggtcatagttgtccaaaagaaatattgaagtatcctgagagttcaaatgtgatcagtggttattgtacttaaaacaattacgtagtaacatcatccccatgttttcaaagtagtattgaattaggctattttggtccttatagtaagcatgggttttcatacctttctgataaatctgactgatgataggacttggactaatatgttggcgttaaatattatttgaatctggtaagaaagaaaaatatattgtatgcttttattagaaatagcaaatatcagtttatttcatcatagccagttttgccattttatagacaaaaacttgacacttttgagagtttaattaaacacgattcagcttttcagaggaagaaagaaaaactaaagatcacagagaaagcttttatacaaattgtagttataaaaaatgttaatgtttcttgcttctaactttctttacaataaagattttattgtttgggtaaagatggaacattcattgtaaaaaaatttaaatacctaaaaaatacaaagaagaaagttgaaaagtaatcatctcactattgtgatatacaagtaagggctgggcatggtggctcatgcctgtaatcccagcactttgggaggctgaggcaggtggatcccttgaggccaggagttcaagaccagcctagccaacatggtgaaatccagtctctactgaaaattcaaaaactagccaggcgttgtggcgcaccccataatcccagctactcaggaggctaaggcatgagaatcgcttgaaagctgggaggcggaggttgcggtgagccgagatcacgccactgcactccagcccaggcaacagagcaagactgtatacacacacacacgcacgcacacacacacacacacacattcatacacacacacacaagtaggtaaattttattccagggatctctctatgccagtgctacttggtagtatgttgaatggcagcctcagcctcagctgggagcttgttagaaatgcaaattcttgaccaacccagatctactgaatcggaatctctaagggagggggtcaagcaagctgtttttaataagcccttcaggtgattcttatactgtacagccatactgcagggatattgtgggcttagttccatatcactgcagtaaactgaatatcacaatagagtgagtcacacacatttttttgtttcccattgcatataaaagttatgcgttttggccgggtgtgatgtgacaggcctgtagtcccagctacttgggaggatcacttgagctcaggagtttgaggctgcagtgagtcatgattgcaccactgcactccagcctggatgacagcatgagaccccatttcttaaaaaaaaaaaaaaaaaaaaaaaaaagctgtgtttatactatactgtagtctataaaatgtgtaatagaattgtctaaaaaacatacataccttaattaaaaatatttatggctaaaaaatgctaacaatcatctcagctttcagcaagtcataatctttttgctggtagagggtcttgtcacaatgttgatgggtgctgaccaatcagggtagtagttactgaaggttggggtggctatggcaatttcataagataataatgaagtttgctgcattagttgactctccctttcataaaagatgtctctatagcacatgatgctatttgatagcattttacccacagtatgacttctttcaaaattggagtcagtcctctcaaaccctgctttatcaattaagcttctgtcatattttaaatcctttgttgtcattttgacagtgttcatagcatcttcaccaggagtagattccatctcaagaaaccacgttcttttcccgtccataagaaacaacttctcattagttaaagttttcttatgagattgcaggaattgagtcacatcttcagactccccttctaattctagttctcttactgtttccaccatatctgcagttatttcctccattgaagtctgaaatccctcaaagtcatctgtgagggctggaatcatctttcaaactcctattcatgttgatactttgatctcccatgaatcacgaatgttcttaatggcatctagaatgatgaatttactttgcctagatccatcagaggaatcactatctatggtagctatagccttatgaaatatatttcttaaataagacttaaaagtcaaagttactccttgatcagtgggctgcagaatggatgttgtgttagcaggcatgaaaacaacattaatctccttgtacatctccatcacagctcttgggtgatcaggtgcgttgtcaatgagcaataatattttgaaggaatctttttttttctaagcagtagatctcaatggtgggcttaaaataaaccatgctgtaaacagatgtgctgtcatctaggctttattatttatagaaaacaggcagaggagatttagcataattcttaatggccctagaattttcaggatggtaaatgattattggcttcaacttgaagtcaccagctgctttagcctctaacaagagagtcagcctgtcctttgaatctttgaagccaggcattgacttctctatagctatgaaagtcctaaatggcatcttcttccaaaaggaggccatttcatctccattaaaaatctgttgctggccgggctcggtggctcatgcctgtaatctcagcactttgggaggccgagatgggcagatcacgagttcaggagttcaagaccagcctggccaacatagtgaaaccccatctcgactaaaaataccaaaaattagcctggcttggtggtgggagcctgtaatcccagttacttgggaggctgaggcaggagaatggcttgaacccgggaggcggaggtggcagtgagctgagattgcacattgcactccagcctgggtgacagagcgagactccatctcaaaataaataaataaataaataaaaaataagtctgttacttagtgtagctactttcacgaatgatgttagctacatcttctaggtagtttactacagcttctatatcagcatttgctgcttccccttgcacttttatgttatggagatggcttctttctttaaatcttgtgaaccaacctctgctaccttccaacttttcttctctagcttcctcacctctctcagccttcacagaactgaagagagttagggttgctctgaattaggctttggcttaagggaacattgtggcttgtttgatcatctatccagaccacttcatatcagcaataaggctgttttattatcatttgtgtgtttactggagtagcacttttaatttccttcaagaacttttcctttgcattcacaacttagctaactggctcaagagacctagcttttggcgtatcttggctttcaacataacttcctcactaagcataatcatttctagctcttgatttaaagtgagaaacaggtgactgttcctttcacttgaacacttagaggccattgtaggatattaattggcctagtttcgtgttgatcatattctttatgttgtcatggttctgtcataattcttttagttctatgttttaatagttttggtgctcattaccagtactgttgcttctccattcccgagttagtccatctcctgattgaatttcattgtcaggcagtcttttcaagttacaggtactgcatgcattctttgggttcttatacacttcattgattcaaaatatttgtcttttgtttttatattacttgaaggattacttggctaggtataaaatttatcagtcacacttttttcccccaaactttgtaaatgttgttccataatctcctagtgtttgattggctggatttctttgtccaatgttttctccttttattaggaagaatttgtgagtattatagtctctgagtttcaatgcttgctgttttctttaatgcttgagaatgtctgtctattgctttcgttcctgaaaaataacttgtttgggaacactttcattagaactttgtggtcactgttttattattttgggacatctagtgttactgtagaaaagtctgatttttctccctccctccttgaaggcacttttttttttttaatctaaaatgcctgagagttttcttctttatttttgaaattcagtaatataaacaaggtatatctaagtgtcacttataatcatttttccctaaattataatatgcccttagttcttctaagaacattttccttgtttattaccatgaatactttttttttggtcaaattattagatcctctacttcatgacaccagtttttttaatactgaattttcttttgttcttcgtatgtattctaattgctttgatgtgtcttttacctttgcatttactgtgatcatctgaagcctttctttttgtcagtaattctgttttctccagtgtctgtcctgtttttgatattttaaatgaattaattggttaagtcattaattattaattaattggttaagtcaataattaaattattaataattattaattaattggttaagtcaataattaaaaataattaattggttaagtcatataggctctaagtttctttagcactacaaactgcattttcatcttattctgcttcttcttgcttttgagcttgtttattataaggttgtattgttttcaagttcttcattatgatgaagttgttgagaattttctttagtttttattgggttatgtatccttccagaatgggttggttctttgccatttgtatgccctattcatttcttcattttgtgttctttcttgctttttattccctgtatgtgtgtgtttctttttgtcaggctgtaatacatatgcatacatgtttcttcttgatatgggagaacttctatgtggtgctgatgggaaatatttttaatactccactctccttacccaagtttgtttttctcctgagccctagtttgaaagctgtatattgttggagtggagggaaagagaagggaaaagtggtgattcagagagccaaatggggcaatgtggcttttaggctctgctctcttgaagtaccaagtatttcactcttgggtctgcccaagtgcttatgaataaaattcctttgccttgtatggggacatcattcgacctcagacctctcatttctctttgttctgagccctagaatgtgacctgaccttctccttcccaaagcatggagatggttaaaactcactcttgaaatttttttgttgacttttccctgtgttgcttattcattcctcggctctactttttgccattttggagtgtatttctggtaagtgtttaggattttgtaaactatttccctacaacctcttattggaggtaggggtagagttgggaatgaccatcaatcacatataactttgtttcttattttgactatcagtcttcaaaatttatggcaggcccttttatatttggttgctgctaataaaatgttggcctttttgttttattttttatttttattttttgttttattagattttgaagaagggagattctaaaatgtagttcaggttttctcagtgtcagcacaaataacattttgggttggataattatttgttgtgagggggttgccctgtgcagagtaggatatttaacaacatccctggcttctacccactagttgccagtagcattcccctagttaagacaaccaaaaacatcttcagacattgccaaatattccctggggagaaaagcaccctggtttgagagccactgatcaattttgtccattcatctttactcctcctaaatacctacatccaaattttaaatagatctttctcatgtagtctggcaagtattatatcaaagataaataccagttttagaataaagcattaatatactcttacatttcaacttaagaggcaaatattaacagtaggatttgtaaactatttattagactaaaaatcaatgaatttttaaaaattacaaaatgatttatgtatgttagatattttactgagtgaaaaaattcatgcttttttaaatgacttattgtttggagtagtgatacagtagatttaattttccccctcattaattaaaattatgttttagccaagaaagtgaacaaaattcttattggcaattcagttgtttcccgttttggagactgacactctccagttctaagttaaataattgtcatggtaaagtaatttccttgaaaagaacggacattgattcagcccctgttactcacaaatgctatttgagtcaaattggaaaactattaagtttttgggaaaaaaatcaataggtatcaggaaaccattagatcttgtggcccttgctatatcttgcatgagtaatcactgtaaacagctgacaggtatttcattgttgacacagagtgatgcttgggggaccacatcttttcagagcaggtggacagctttagacgttggaatgagtttgattatccttgtttttctcctacactcattcttttagacagccctgtcactaactgggcctgtgatgctttcaaaaatcaaatactttccttgctgtcagttttctttttcttgcgttgtggcatactaatcagggtatgtggtttggtactgaaccaatttctgtcaaaagcaagttttaatttattatttaggaaaaatttttcctaagacccaggttttatacagtcctaaataaatagtgtgaggaataattagtaatgccatagagtatataattttacttctagttctacacagattacaagtaaattttttttgggcaagtgattttggaattatctatgttttgttttccttttcctttagagtgataattcactatttatgattgaatgattatcatattaaagaggtgagaaaataaaaataagtctgatgtgcacaaagccatactgctcaaattgtttgataatatctgttaattaaattattatggcatcggtagaagaatgatgttttgtttatatgtggttagaattggtcttttttaaaggaaataacaagagagatggaaatggaatgggtataaatagtaaaaggttctatcactataattcccttttgctctaaatagttaaagcttctatcactataatttccataagaagatatatgtgtttacctgttaattttatcagggcaaattaaaacatggatagaatcatgtttctcagtgtgaagaaatatttttatttgatgaatattatatattttcaggtgcagtgacttctatgttttgggttgatgctgaattagggagtgatatttaccttgatggtaagttaaaaaacagttttcttttatctttcttgttttttttttgtttttgtttttttttttctgagacagagtctcactttgttgcccagactggagtgcatggagtgcagtggcatgatctcggctcactgcaacctttacctcctgggttcaagtgattctcctgcctcagcctcccgagtagctgggactacaggcgtgcaccatcgtacctggttaatttttggatttttagtagagacggggtttcgccatgttggcctgactggtcttgaacccctgacttcaggtgatccgccagcctcggcctcccaaagtgctgggattacaggctgagccaccacaccctgcctcttttgttttttagtaaaatctttatggttaagcttattgttgttcattcatgttataactttaattccttgcattgtggttcttttcacactttagtttaatgatgaaatctttgttcatatagattaaaaaaccccagacagtggtggaactcgatgtcactcaacttccaatttagtgcttccactaaggttttctttaaaaaaaacaatgctttgtaggttttctgtatcctctgttgtttgatttatgtccttaatgtaatgttagagccttttatttttatcctccaggcaatatgaggatcatatttttgcttttattttctcttgaagataagaattaaacactcctcccttactttatttacctgaacacttttgggcaatgatatgccttcatttaaaatatattagaaactttcttagttaagcgactatgttttctccctttctctttccctttttcacctttttaaaaaccagtcgaaattttcttactttttcaaaagtaataatcattaagaaatttaagaattattaagctgggccccatcattgagctctaatatatgtggcgggtaactggttgaattccttaggcataattaaactcattcttttgttatcagcatatattcagagactgcaaaatgaattggtagtttggaaacttaggcatatgttatgtaaaacatttatgagttggatttggatttggtgagagatgttaggaatgataccttaagatgtctcattctttaggcaataatttaaatcttaagaaaagtcttttttttgattatgtgaaaataaactagaaataacctgtcttatgtacttatcacatttgactatgttatgaaatttgacttatattttggattgtaagctttttcagtgccaaggaaatcttattttcttatttatttaatttaaaatttttatttgttttatatcttctctagtgccttaaaatagtgctagccactcaggaaatgcattgacttattactggaatttaattaaatggcagcactggcaagagaaaaaaacagtacattgttttattgagtagtatttgtgaactgaaataggttagttttaattttcattctgaagtatggttgcacaagtattaataagcattctttttaaaaagtgattaaaatgttttttcctttgtaggtatcataactattgtggattcaaaatatggattaaaagtaagttgaaagattgctatgagtggctcattattgagagctgggaatatggggattgattgtttaattttctttatgtttgtatctgaaattttctttaacaaaaacctttctcaaaaagatatcctgaacaataggtgaaatttgtgttttaattattagtttgtgttaaatatttcttttctattactctgagtttgatttggtgataaaatttggaattataatttgtaataagcatatggggttaggatagagtttggtatgtatagctcttcacaaggattcaaccccaatattggtaagtttttctgttccatagaagaagctgagcttgataaagcatctgagatcttatttttcttgttaaattactattaaacacacactggaaatgagtttttaaaaaatattgaagacctaggtgatgggttaataggtgcaggaaaccaccatggcacgcgtttacctatgtaacaaacctgcacatcgtgagcatgtaccctggaacttaaaatttaaaaagtacatattgaagaaaatcaggatatacacataggattagtaagaagactctctccattaaaaggcatcttgcatcgcttcttggtcttttggctaagatcaagtgtaaaagacatcctgctatgaatgtttttgttaacttctaaggtcctagaatgcatttaaatgaggtttaatttataaaatgcatttagtaagatctttaaaagtatgttgttacatacagtaaaatgacgtttctcaacttcccaggtgaaataccactaaaggcagaagagaatgaaatcatcccacccactgacccgttcccaatctgagcatatggatagggcccaaagcagtaagttcttagaagtttaaattcagtgtttaaaaattagtgactgttttgtatccaacctcatatctgaacatgttaatttttttttttttttttttttttgagacagagtctcactctgttgcccaggctggagtgcagtggcaccatcttggctcactgcaacctccacctcccaggttcaagcgattcccttgtctcagcctcctgagtatctgggattacaggtgcacaccaccatgcccagctaattttgtatttttagtagagacaggattttaccatgttgaccagcctggtcatgaactcctgacctcaagtgatccacttgcctcagcctcccaaagtgctgggattacaggcatgagccaccacgcccggcctgaacttgttaatgtttaagtttgcttttttttttcccaaatctttgctgaaattatgctctaaggggatatgtcaggtttgtcaaatagctaccaatacctcttcactgggccttctctccctcgttgatagagtgccctaatttgaaaagtttggaagaaaactccttttttagagtttaaaatctcaatttatgaatttatgaatataatttaagaatcaaagaatgatcccaaatacagtattacagtttcacgcagaaaaattccaatgactgttggaaatcatatttcttgaaaaatgcttatggaggtagcaaaaaagccccaaattattcattttgaatgtttattataggcatgtttgaatctacctcttccataaatttattacaaaatttgatatacctatgtgacagataactgctaagacattttgttttttttttattttgatagactgaaaatgccatgctaaaagtcaaactgtttatgtattttatgattataggaaaaattttatatgtatagttgggtatggagaagagttaaatagaatctattatcagcatgatggaggccaaaaaaacaaagcaacattctgaataatgcaaacacagtaaacgtttaaccttctgctaccttgataaaacctcttaaattattaaatcaatatacctacacgaaactgacacactgtcaggataatggaaactttaaattttctaagtcggatgccagataaataactttgccttgatataaagaattttccaacttgtccaattcctctggttgcaaagcttgacctcagtagctgcttgtgattcagagaattctgaggcagtacaagtaatgacacttggataatgggcagcaatttaagaatgtcatgcttcacagagccagcccatgacaagtaaagctgagaaatggtaccctgtggccagccagccaaattgaaactgaagtggtaattgatatcatggggtatcactctaatgggattgtcacccattgatctgaaatattcattttttaatcataggcaaagaattggacaacttaaaatgacagctctctattctgaggacttgacacccgggctactgacattgttcttttcagttctacaaatgtgacagcatttaatgcaatagaagcaatgaatgaagttacccagagaaggtcaagtgagaggtttcttcttggttcctctgttatattgcacaatctgttgaaacaattcagtcagaaaacagttagcttggaaaaggccagaacaataaatagactgacattatgcaataattttttaaaaactaaaatagtgttacatctgtaaccaatccatttgaaagaaatagttcctgctgctgctttttaaaaatgacaccagacatctttgacactagatttatttccactctggtcaacagcagtgttctttcatagccagtgggttttaagacagttttttcttttctttctttctcttttttcggtccggcttctttctttatttctgcagaaaaggacaccctatagcccttcatgaagttaggtctacagtggtgttatttcagagagttcctttgtttctctccctaaccccccagctttattgaggtataattgacaagtaaaaactatatatatttaaggtatacagtgtgtgaattacattatcaaacaatcgagctagttaacctatccatcacctcacattgctatttttttgagagggggtggtaagaacaattaagatctatgttttagcagattcaagtatacaatagaattaactacagtcatcatgctgtaattagctctccatgacttatgcatcttgtataacaaactttgtattctttgaccaacatctcacaccactcccctttaatttcctttgtttcttgtgataagttaaattggggttttgatccttagccttttgaatatgttggattaattagtatcaaaattatttttgtcttttttgatatataagcaaaagccatagttgttaagcagagataaggaatactttggacatctatgtaatataaaatatttaaaaaatattttgcaaaatttttttcttcatttacttatacaggtggaatagaatgccaaactttccattttgttttattttataaatgaaagtcatctgacttaacgaccaaatggtatataatgtattattggagaatgttcttttgaatagaagacattgattttatactttttgcagagtttgacttgggaaggtaggaagtcacatgagggaaatgcagggctgatgtctaaagaaaataaatgttaatatgcacttatttttttaaatgtttgtatagctttcctatgggcatagaagaggacatttatctcttctgctataattgtatatgattacatataattttaatacagctgtaaatattggcaggctctcatttggggtgattttcatttatttttatatttgatactttctgactgcctggaagtagtaaaacgttagtctaccactgttagctttgagtgaagaattctaatattttggagaggtaaatgcatttaaaacattgcacattaccttgtgaaactaacattgtattagttacatttaggcatggaaatgcaaaaacaaatctgtaattcttctgtcatatcatttttatgcctcacaaactcatagccaaataaccccaatttcatatgttaaaaaagctttcataaggtcaataatataatatcttgaaaaatatttcagtttaaaaagaattttcagtactataggatcattcagaggcagatgccttgccaaaaatatatcattgttaagtagatttactgcttaatgggaagagatttgttgctgcatgttagatggcatttttcatgtaacatcttttatgtatccccacaacaggaggtgttaattacaattcattcaacaaatatttcttgagcctttgtgccaggcaccattccaaggtctgttagcagcctcattctctagaggcagagtatataacaataggacttgttgtagcctcaggccaagatgaattatgaaaaaaatattaaacttgatcttttggcatggaatgatttttgatacaatacttgtcaagttctgtgacttccataattgcagagtgggtctgcagttgaattgaacaagattttgcctgaagtagaagtatcattgccatgattttatttcagttttgttttcctcaaaatagaatttgctgaacttttagaaggaaaaaatgtttcttctatagaactaatcaagcgtgttaaataaaattattacctgcttgctctgaggttccaaactattcagatacccctaatgatcatctccccatgaattatgaaactggtttggctctgatatatggttattgacatttgtgtagcattgtacacagactgattttatgtggcataaaagatttcacaaaggctttaaaattatgttcattttacttgatgggtgtgtgttcaattaaaaaaaaagtccctgtgattgtatataaaatatagtatcctgtgatgatgagggtgttagatttagtttcttcctttataaatgaaaatagccatctcccataattattatgaaagctaaatgagaaaaatgtatataatttataaagttagattcaaggatttaattcatttgtaaagttggcttcaaatatagagtattactataatctagttgcctctaaacctcagtagccagctttttattgtgacagggaacctctattgaggtttgaggtaatgagggtaaaagtgtaatttcccagagaagaagcttgtgatgttgatgacgttagggatgtaaacaggattatgagggggaaaaaaaaaaacagacaacaaaacttgcctccagagagatggaaactaccacttgggctctaagtcagtgtcaaaatattttttggagttagcctgactctggagaggtcagtaaaataaacagttgcactgagaggccagattagcaagtatgggtttctaaatgataaactgcttttaggctagaatcagggctgaatcagccttcccaccacttatttgtttctagggtgtttgaaaggcctagtactgagttcacgtggtgcatgattgtgggctggggtgcagggaagtattttagattctaatatgggggtttggtgtgaagggaagtatattagattctaagaaactatatttcagtggttatcctttttttaaaataagtaataatgaatatttagaaccagaacagttttgtaagaaggaaaatacctaaaatctgaactgtaatcttctatgtttttatgacattatgtgaatcaaaggggttttccttttaagtaaaagaaaaggtcaggagtatgaaatcctaagccctcttcctccccctataaaaccccacaggttcacttgtagaaaaaaattgcaaatgaggaagaaaaatgctttcagctagaaaagttagttttggatttgtgtattcagtaacagaacatgttgaagtttttattaaatgcaagaaaatgtctctaaagtaaaatcctttgtgttgacattagattttttattgtattatagtaactttattcaaacttttttttgtttagcatttaacagaagagaaacctgatggccttatcaatgaagctactaggtattcatatttaaagtatatattgattgctggctaattgtaaagagaaaaatcactaagatgaaaaccaaaaacaaactaagaaattttaaaacatagtcaaggaaaatttgttttctttttttcccttagttgaattattgctatctatttataatgatctcataactaaacttttacttgaagtcatttttgtcgtagcataaagtgaatgctgaacacaggagttctgtaattttgaggaactcgggaaatattaacatttagaaatattttcttgttatacaatttctttgggattgaagattttttatatatatatatatgtgtaataataattattattattattttttgagacagaatctcactctgtcacccaggctgaagtgcaggctcactgcaacctctgcctcccaggttcaagcgattctcctgcctcagcctcccaagtagctgggattacaggcacccgccaccatgcccagctaatttttgcatttttttattttatttattttattttattttatttttttttagtagagatggggtttcaccatgttggccaggctggtctcgagctcctgacctcaggtgatccacccgcctcggcctcccaaagtgctgggattacaggcatgaatccactgcgcctggctgaacttaagtatttttgtaacttttttccttatgaaaatatggttattatagaaaatataaataagccaaatagaaaatagccaaattggatttgtgatgtacatactgttgaaacctgctctttcagtgaactaaagttaatttagttttgagaatttagttgtattctttgagataaagcataagaccctgaataattgaggaaaattgaaagaatttccagttttactatcctgttaatagaaaatagagcttctgattattatcatctactttgttatctagcattcagtcaactggattctttacagagataatatacagtatatttatagtgataaagaagacatttgtgcaatatcctgatatatcttctgaagtatagcttattttttttaagaaatggagtcttgctatgttgcccaggttggacttgaactcctgggcttaagggatcctccctcctcagcctcctaagtagccaggactacaggtgtgctctaccatgcccagctctgaagtatagttttaaaaaacctgtttaatacagtttttagtattaagtgaagttattctatttctttgaaaattttggtaaatattacagtattttagtaggtaaactcttcttctttttaccatattggatatctgaattttatgcttttcttcacaaagaaaattatgagtttaaaatcatccttttgattgtaaactttttgagacttatctttgtagcgcaagagtagcaagtaacagaacttagtaaatactttgcaaatgggtaatgtgaaatctgaacttgcatagtaatgaatacaattcattcacattgaaaagttagcggattaggagtaaactgaatcactcctatagagcactatataattcttaactgatatattgatctacatgaggtgtttttatttatttttaatttgttaacatttctcttttgatgtattaatctgcatgcgtgtatattatttaaaatttcttaacatttctttttgtttgctattttaggcaagttgctttggcagatatcattctcattaataaaacagacttggttccagaagaagatgtaaagaaattaagaacgacaattaggtacaaaatgataagtgtgttaagtgcctacagatccatattgtatacacagaatattttttactctgattgttgccctgtagaaacttaaggtataaggttgacctgcttcaagaacgttagggaatcacatatattgttgatggctaattgttatataaatggtaatacataaaattagtcctcagtgcttgcagaatatagttcacagttaatagactgatattcagggtcttcgcactccatctttcttttcctgtcttctctttgactctttcctaatgtcagtcttccctaactttacccaggatggttaattcactttcccatggatgcatcctctcagttcctgtctttactcataatgtattctcactctgccaatccctgagttctttcttgttctgtttttttttttttaaatttattctatagagcctattctgtctctccccgcttcctatgtgaagtcttccctgactcaagtggtctcagttttccctgaactcttgttgacttcatcttccttaactgtcaaccatgccttgtcttccagcttgcttgtatatcttctttgtccatagccaaggctgatcagcataggacaatcaggacaatatgaatgatgctcaaatatgtgctaacagtcattttgctgactgttctggagactcccattccttttgaaaacaaagatggacttttcaaatgaagttatagttcagggactttgttttgaattattttgtaagacctgaactaataaaagccctatacagagagacattcggtagctattattattggttatctttaatgtgtacaatgctttgagcgtgatggtggctcaaaattactattcttagtatttataagttctactgacattagattttgaatctgtcatctcagttcatatagtatatattataaattgaatcaataaaggtaaggctcattaggagattatttgccatgattaatgattgtggaagaaagaaattcacattttttccacatatttcatcttattttaatagtaatgtccttaaactttactataaaaaaatataatgtctccatgtggagggtaggtattgttgcctagtgttgaagatcacagaccttggaatctgcttgggttctaatccttggtctgtttctcattgtcttcttagggagcttatttacccttttaaagcctcctctgtaaaaggcataatgcctatcataagtttgctttgagtattacatgagacaatgttggtaaactttgcacagtgctgacacatagtaagtgctctgttagctattattatgtaatttttttcttagcttacatagtaagttcaaggtatagtaaaaaagggaagaaagaaaaagatggctgattttgaaaaggagaaagtgatgaatgaagattgcttttacattttttgacactggtcttctaatcttgtttccttcataaatcttgtgcaccattgtgattgctaagaagaacacaatctatttagcaaacgtttttggcataaaaggaatgataattattacttgacttttatatccttatagagacctaagctaaatctctgacactgacaatattgactattagccagcttgttaacagtactagaaatgaatttggaagaagcaatttgataaattacacacccttttggcttttaccctccctttatatcagacttgtgactgactcagaatgatatttggggaggtgaaaaaaggtaaacatgtttgagaggaattagccatcagactagagtgtattcaaaaaagaagatttaagaattttgtaaaatagtggagagacttgcctcagaatcattatatgtgggaagccttacccatgagaacaaccttgaacaagtagcaagaatcttgggtaagtaaccctaaagacaattgaattcatgatagagaattgatgattgatgataggcaatggaaaagataaatagatgaggtgtacagtgtgctgaaaagaatttaacaggtactttttggtgccatacaaagccatattctatagtatcaaaagagggagaataggcataacgggtagagagcctaattagggaactgacgaggttattctataaaggaacctgggatgtgtgacttagaattactgtgaatactaaggacagactgggggcaaagcaacttacaactaggtttttatttttagtgtgtatatagccatttctaccatgtatgcctgaggaaaaaagtgaccaccgtaaaaattttgagtatctactcatttttaagatcactaggataactgactatttatgaatgattttttctaaagtgaagcgtctttttattaaccacaaagtagcccttaatctgacagttgtgcgaatttttgcatatatgttttattgatgtatgagtggaatatatgtgatttattgtttgaaggaaaatcataattattttttaaagcaagttttgtttttctgtttttaatttttttctggttccagatgtatttgggtatgcttatttcctgttttagaaacaatatactttgtatacttttttaaaaagttaatttttacttttaaactttgtcttcctcatttattatttatttcagatccataaatggactaggacaaatcttagaaacacaaagatcaaggtactttaaaaaagctattcctattaataacaaatcattttagttattaataataaacattaagtaattgacaaatatgcttgattctgatataagaaagatctaagttcatttaaaaagaattggatccaaaatgttgtttggaatgctcttaataagttagtttggcatatttggctagtacatttgcctgtcttcaaaactaagattacaaagccatggtaacactgtgtaagtgtttgcttaatgaggaagaaaagacttccaaacactcgagagggtaactcagtacagaaatctgaagtatattgaggaatcttaatttgaagtgtttaaatggcattttaatatttaaaaagccttcttagtgttttatagttgccaaaaaatacatggagtctttaccttgaagttcctgacaaattcttttattaaattttgactttcattttctctaggttctgttcctaaaacatctgtgaagtgtatttctgtagattaaattctgttttccattgaatgttatcttaatttcagaaaatttctgtgcagggatattttattaagctcatttttttttttttttttttttttttttttgtggtgagaaaggctcagcagctgatagactcagcaacaggcagccaggagctctgaggctcacagctggcagtctagttctactcagtctctacttgagaaattctttctttggaagtacagcagaggccttagatgagtggcttgtctgctatggcagagattagaggtgctgccagactgccattaagtgttaggcagtaacagcagcagctgcttatatgcatgtgaacagctggggaattaatttggtatgcattctcaggagccgctcatctgctggcagaggtagccgaagaatgccctttagtgtaagtcctctacaaccatacaccaaatgtgctccctgcatttcaaattccattgtagaaagtctctgataatctcacttataccatgagccattcctcagtatctgtcctcttcctgttagtgttctacaattcctttctccttaatttttctccgctttacaaaatgtcacacagacaagtgcataatacttaaacaagcttttaaaaataatgctcataaatagctttggttctgtcataatattcgtatttataaacattttaagtcaattctcttcttttgttttcatttcagaaatatccatgtcctgaataaaagttgtgtcttgattagtttattatgtaacaatttagtgtgtttgacatttctaacttttatttctaacatttgctttattatagaacaataaacatgcagtgattgatttttcttacttcaagtggatgagtgagcaagtgactaaaatcttctgtgaattcttcagtgtatggttcttgccaatgcatctgagaatctagggactttctgaaatagtacttccttgctatgaggactgaagttggattagaatccgtttcaatgaagatcagatgtcctgagtagaattcttactattgggtcctgaatcttacattaaatattctctcaaattccttgaggcatagcaacttgagcttaccagtttagaaactggagatttgggctgggtgcggtggctcatgcctgtaatcccagcactttgggaggccaaggtgggcggatcacgaggtcaggagatggagaccatcctggctaacactgtgaaacccatctctactaaaaatacaaaaaattagctgagcctggtggtgggcgcctgtagtcccagctactcaggaggctgaggcaggagaatggcgtgaacccgggaggcggagcttgcagtgagctgagatcgcaccactgcactccagcctgggtgacagagcgagactctgtctcaaaaaaaaaaaaaaaacaaacaaaaaaaccggagatttggttaacaaaatagtcaaagtcactcttatagaagttttgttttattttttgtttttttaaatttttttaccattttgtagctgacaagtactgacaataaactgctataagcatgtgtagaaaaaggctcaccttgagtagttaagattaaggaaaaggaatagtgtgtagcatcgtcttagtggtaagacttaagttgatttagtagcaaatggaagtactagtgaaccacatagatttcagaagtaggagtaaaaggttagaagatgtgtcattttaatcttctctagactttttcttaatttttagaaatgtaagtggactgaacagaggaaaaccaaaacacagctggtcaataataagttaaattaatttgacaaactgcctgctatgcatttcatagcattttaaggactatataagcaatggataaggcgaaaactctgcctttaaggagatcagtcattggggggaaacagaagcaaacaaacaaaaaggcaacataatagatattaatattaatacaagaattttaaaagcacagagttctataataataggaaaatagagggaatgattgctcaacttttcttgaaaaagagtcaggaaaatattgaccgagaaggcagtcattgacctgagtcttaaagaatgaataaggtttttacagatggagtagggtagggataactttccaggtataaggaagattttgtattccagggacctttgaatattttagaatggctagaaaacttggtattatgtagcacagaaaaagtggtatgactgaagagatagagaacttaccacaaagggtcttgaatgccatgatacatagtttggattttcttctgtagggagcaaggagttagtgaaggattttaaaagcaaaatgactcttgggaggtagattcaatgtgaggctaatctccgaggtacaggaaatacaggaaggaggagcaacaggtcgggtagtggtggaagcaggtttggaaaatgtgattagttttgtaaacgtttttgagtttgaattgccactggggaaggcttttggaaatttatttccagagttgaagactgagctatcattgcagtttgctcagctatttactgagctatctactgtcaatttggatagtatctacagtttgcattgtagatactggatacttggattggctggtgcaccctgtttgtgagactcactggagtttgaagagatgaccactggaaaatatccctaagcagtagctgcaattccacccccaccttggagagccaaaaccctcttcgttttcactctcctgtccttggtcttaagctacttaaagcagcctttagacatagggaaaaattgaaagcctctcttttaagaaaaacattaggtacttctggaatagagagttcaagaaattaggagaaaaatgaacttttgaagctttttctttcccttttttgtttacttcattctcttactcagttttaaaatgctggtaatggtcttttttttcttttttttttttttcttggcgattttaatgctttggaaaagatctcatgcttttatctccaaaggaggaaattaatttgatgccatggaaattagttttctagtcgtatgccttgaatgagtgaagaatttctttttcatggtggtactaaatttggggaaagctatagaaactttcatctggaagcttacacttttcctcttttttgaaaatttggtgagagacttggatattttattattttctgtaaaagagtgtaatttgttgtacaggtctaatattgatccttttttggaagtatggaaagaatctgagtataaagcagaattacctctggatggcatgtattctcaaggacactgtcatagtgaaacagtttatttagaagcttgtgtttccaaactgttgaatttgatattcacaaaattggcatgtgtaaactttattaaactttaagctatttcctaagatgaagatgacaaacttggagggaaacttcattcatttggtttatttttatttttatttttatttatctttttgagacagaatctcactctggtttgagacagaatctcactgtgtcccccaagttggagtgcggtggtgcgatctcggctcactgaaaccactgcctcctgggttcaagcgattctcctgcttcaccctccgagtagctgggattacaggtgtgcaccaccacacccagctaatttttgtatttttagtagagacggtttcgccacattggctaggttggtgtcaaactcctggcctcaaagtgatccgcccaccttggcctcccaaagtggagcccccgtgccccttgtttgtgacctgtcaatataaatatgctcagtagcggggggaggggtggggggtgaaaaaggaaatatgtttaatattaagactttggccttttagtgtaaactgatattcaaaaatttcttcatagaacatttgcttctttgcttgatcatttttctaattctgtacatctaaaatgcccagaatttgagttgctgttatagtctactaacatagaactttggagtaataagatgggaatttgtctctcttttgccaagacaagtattcgtaatctaacacagtattgttgccacgagtacgagtatgtgatagactgttgagaataaagaaagcaggcacagttggtcagtcctaagataaaggagatgttttttcttatatgtttgtgcattaaagaaaaaaaaatcttgaatctgaccaatgatgttttttttccttgtaagaaaatttaacaaatgtttggcaagcttctggaatctaaatttgaaattatacatttgtcattttctttaaatatttcttcaccttagctttgattatgagaaatcactgtcctctgctgttctttttttttttttttcttttgaggcggagtctcactctgtgccaggctggagtgcagtggtgcaatctcggctcactgcaacctccacttcctgggttcaaatgattctcctgccgcagcctcccgagtagctgggactacaggtgcatgccaccacacccagctaatttttgtatttttggtagagacagggtttcaccacgttgtccatggccaggatggtcttgatcttgaccttgtgatccgcccgcctcggcctcccaaagtgctgggattgcaggcatgagccaccgtgcccggcctgtcctctgtggttttctgggcttatgttaaaattataactcaatcaccagtctttataaatttgcttttttatatttaaaccaaacctaatgctaattgtgatatgttatttattctcacctgatttgaatcattggattcaattaaatgagtttaattatcattaaataattctaagagaaataatgtctattcggatggtgggaattttctttctacatgcagccccattctgaatgaatgaaatcaaatcatgtgaagatcagggtcctagagtaacctaatattttgtacattggttatttgactcctcatttttatattaaatgttatatcaagggagggggtataaaagaaatacaaaaattgcagaggtatctggaatgtacctatttgttaattctatttgtcatttcttttgtttcatcttttgagtaataagctgcttggaaaagtttctgttctttagctgattttttagctataaaaatgtatttgaaaagctcataaatttcaggattgaaaagataattggaagtttaaaaaaaacctaattcattgaagtaataaccaaataattttcaatcttgattcaactgtgattcaaatcttacaccatttgcccacttctatgaattttatgtataaaattttttaagagtcagagtttttttttcttgattaattggatgtatttcacagaatttccaactgctcacgttagttttcttccttttagagttgatctctctaatgtattagatcttcatgcctttgatagtctctctggaataaggtatgttttgtataatttggttacttttattgttatgtaccttttttccccatagttaacaggaatgatttgcacaattgcatccatgatttaagcttcctgccattcctttggcttacaagaccattcttaatgaggtatattcttggaagttttactaattggttgtttggaaatcatattgcattttcctgtagaaattatagtgtaaatgatagttaactttagaggctaatcgttaacacttctacaccaaacactatgtctaatactctttctatgagaaaatgcatgaaatacatggaaaattttagcttagcgttttcacacaaataactctcttcactttatttttttattttttattttttcttgagtttttttttaaatttatttatttattattattatactttaaggtttagggtacatgtgcacaatgtgcaggttagttacatatgtatacatgtgccatgctggtgggctgcacccactaactcgtcatctagcattagttatatctcccaatgctatccctcccccctccccccaacccacaacagtccccagagtgtgatgttccccttcctgtgtccatgtgttctcattgttcaattcccacctatgagtgagaatatgcggtgtttggttttttgttcttgcgatagtttactgagaatgatgatttccaatttcatccatgtccctacaaaggacatgaactcatccttttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttaggttatatacccagtaatgggatggctgggtcaaatggtatttctagttctagatccctgaggaatcaccacactgacttccacaatggttgaactagtttacagtcccgccaacagtgtaaaagtgttcctatttctccacatcctctccagcacgtgttgtttcctgactttttaatgattgccattctaactggtgtgagatagtatctcattgtggttttgatgtgcatttctctgatggccagtgatggtgagcattttttcatgtgttttttggctgcataaatgtcttcttttgagaagtgtctgttcatgtccttcacccactttttgatggggttgtttggttttttcttgtaaatttgtttgagttcattgtagattctggatattagccctttgtcagatgagtaggttgcaaaaattttctcccattttgtaggttgcctgttcactctgatggtagtttcttttgctgtgcagaagctgtttagtttaattagatcccatctgtcaattttggcttttgttgccattgcttttggtgttttagacatgaagtccttgcccatgcctatgtcctgaatggtaatgcctaggttttcttctagggtttttatggttttaggtcaaacgtttaagtctttaatccatcttgaattgatttttgtataaggtgtaaggaagggatccggtttcagctttctacatacggctagccagttttcccagaaccatttattaaatacggaatcctttccccactgcttgtttttctcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattgtgtgaagaaagtcattggtagcttgatggggatggcattgaatctgtaaattaccttgggtagtatggccattttcacgatattgattcttcctacccatgagcatggaatgttcttccatttgtttgtatcctcttttatttccttgagaagtggtttgtagttctccttgaagaggtacttcacatccctagtaagttggattcctaggtattttattctctttgaagcaattgtgaatgggagttcactcatgatttggctctctttgtctgttgttggtgtataagaatgcttgtgatttttgtacattgattttgtatcctgagactttgctgaagttgcttatcagcttaaggagattttgggatgagatgatggggttttctagatatacaatcatgtcatctgcaaacagggacaatttgacttcctcttttcctaattgaataccctttatttccttctcctgcctaattgccctggccagaacttccaacactatgttgaataggagtggtgagagaggacatccctgtcttgtgccagttttcaaagggaatgcttccagtttttgcccatttagtatgatattggctgtgggtttgtcatagatagctcttattattttgaaatacgtcccatcaatacctaatttattgagagtttttagcatgacgggttgttgaattttgtcaaaggccttttctgcatctattgagataatcatgtggtttttgtctttggttctgtttatatgctggattacatgtattgatttgcatatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcaggatgatgctggcctcatcaaatgagttagggaggactccctctttttctattgattggaatagtttcagaaggaatggtaccagttcctccttgtacctctggtagaattcggctgtgaatctatctggtcctggactctttttggttggtaagctattgattattgccacaatttcagatcctgttattggtctattcagagattcaacttcttcctggtttagtctttggagggtgtatgtgtcaaggaatttatccatttcttctagattttctagtttatttgcgtagaggtgtttttagtattctctgatggtagtttgtatttctgtgggatcggtggtgatatcccctttatcattttttattgcgtctatttgattcttctctctttttttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcgttggtttcaaagaacatctttatttctgccttcatttcgttatgtacccagtagtcattcaggagcaggttgttcagtttccatgtagttgagcggttttgagtgagattcttaatcctgagttctagtttgattgtactgtggtctgagagatagtttgttataatttctgttcttttacatttgctgaggagagctttacttccaagtatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcattgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggttgaaagtctgttttatcagagactaggattgcaacccctgcctttttttgttttccatttgcttggtagattttcctccatccctttattttgagcctatgtgtgtctctgcacgtgagatgggtttcctgaatacagcacactgatgggtcttgactctttatccaatttgccagtctgtgtcttttaattggagcatttagtccatttacatttaaagttaatatcgttatgtgtgaatttgatcctgtcattatgatgttagctggttattttgctcgttagttgatgcagtttcttcctagtctcgatggtctttacattttggcatgattttgcagcggctggtaccagttattcctttccatgtttagcgcttccttcaggagctcttttagggcaagcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagagtttctgccaagagatccgctgttagtctgatgggcttccctttgagggtaacccgacctttctctctggctgcccttaacatttttcccttcatttcaactttggtgaatctgacaattatgtgtcttggagttgctcttctcgaggagtatctttgtggcattctctgtatttcctgaatctgaatgttggcctgccttgctagattggggaagttctcctggatgatatcctgcagagtgttttccaacttggttccattctccccgtcactttcaggtacaccaatcagacgtagatttggtcttttcacatagtcccatatttcttggaggctttgtttgtttctttttattcttttttctctaaacttcccttcttgcttcatttcattcatttcatcttccatcgctgataccctttcttccagttgatcgcatcggctcctgaggcttctgcattcttcacgtagttctcgagccttggttttcagctccatcagctcctttaagcacttctctgtattggttattctagttatacattcttcaaaattttttccaaagttttcaacttctttgcctttggtttgaatgtcctcccgtagcttggagtaatttgatcgtctgaagccttcttttctcagctcgtcaaagtcattctccgtccagctttgttctgttgttggtgaggaactgcgtttctttggaggaggagaggcgctgcgttcctttggaggaggagaggcgctctgctttttagagtttccaggttttctgctctgttttttccccatctttgcagttttcatctacttttggtctttgatgatggtgatgtacagatgggtttttggtgtggatgtcctttctgtttgttagttttccttctaacagacaggaccttcagctgcaggtctgttggagtacccggccgtgtgaggtgtcagcctgcctctgctagggggtgcctcccagttacctcccagggggtgacctcccagggggtcaggggtcagggacccacttgaggaggcagtctgcccgttctcagatctccagctgtgtgctgggagaaccactgctctcttcaaagctgtcagacagggacacttaagtctgcggaggttactgctgtctttttgtgtgtctgtgccctgcccccagaggtggagcctacagaggcaggcaggcttccttgagctgtggtgggctccacccagttggagcttcctggctgctttgtttacctaagcaagcctgggcaatggcgggcgcccctcccccagcctcgctgccgccttgcagtttgatctcagactgctgtgctagcaatcagcgagactccgtgggcgtgggactctccgagccaggtgtgggacacaatctcctggtgcgccgtttttcaagcccgtcggaaaagcgcagtattctggtgggagtgacccaatcttccaggtgccgtctgtcacccctttctttgactaggaaagggaactccctgacccccgtgcttcccaagtgagacaatgcctcgccctgcttcggctcgcggatggagcatgcacccactgacctgcgcccactgtctggcactccctagtgagatgaacccggtacctcagatggaaatggagaaatcgcctgtcttctgcgtctctcacgctgggagctgtagaccggagctgttcctattcggccatcttggctcctctctcctctcttcactttaataatggattagttttctgccttctgctgtggggaatctttttggtaagggagagaagaaagattagttattcttgtgcatcggtatctttttctttttttattgtagtaagaacatctaacatgagatctaccctcttaacaattttttaagtgtacaatacagtattgctaactataggcatgaggatgtgcagcagatctctggaacgtttcactctttataactgaagctttataccccttgaatcgcagtttcccatttcccagtcttcatagcccctggcatccaccattctacactctttctatggggttgactattttaattacctgacacaagtggaatcatgcattatttgtctttctgtgactggtttatttcatgtagcataaagtcatcaaggttcatccatgtttttgcatatggcaaggtttcctttttaagtctgaataatattccattttctacatataccacatttactttatccctttttctgttagtggacatttaacttgttctcacagcttggctattgcaaataatgctgcaatgaatatctcataagtctcgtatatgtccatacaagatcatgaaaatggacatgtctctgggtattttgaattggtgggacaattttgcttaagggtaggcatagtgggtggctctacatttgagagttctaattcccattcctatatatatttcttttctttttatttatttatttttttgagatggggttctctgtcactcaggctggagtgcagtggcacaaacatggcttactgcagtctcaacctcctgggctcaagtgatactcccatctcagcctcccaagaagctgggaccacaggcatgtgtcaccatgcctgactaatttttttttaattttctgtaagcatggggtcttgctatgttgcctaggctggtctcaaactcctgggctcaagtgatcctcatgcctcagcctcccaaagtgctgggattacatgtgtaggccaccacacccagccttatatatgtatttctaattttgccttagccatgcccttaaaaactaattatactttcaactagtttttttttccaccttcagtctgtggtattgttcacattttgaaaacaatacctacagtaacctgtgaggtaggacatgatagtgttttattggaccccttttactttatgaattggaaaaattaaatttgcatgtagtttgtaaaaaaaaaaataaagaaaaaagaaattgattgagattatttcagcagccagaagtgtgggacaggcagggcagttattcctccttctcagtttggaaactgaagctcagagagtaaacttgtcagtgacacagttattcaagaagttgtcttcagttgagagatatgtttttcacctgtagcttctggtattggagcagtacctttttagactaaacaaattacagttaaaattataaaggtatttttggagtacctggaaaaaatcagcattttgcttttctagttccatttagtaggaaggcaggaaagtttggtatacctgaattacatgtgagttatttctatttttctaaaaattcttataaattgtgtaaggtaaaaatgactacttcttgttttatggtaaatatagttatatcctttcaagccactgctgtacaaagttgtgaaatctccctgagcctttttccctcatgtcagcttcaggtatccagtatcacttatgcttgataatgattgtatgaaaatcattcagaattatactatgttttttcatataaagcttttgttttactaattttgaaataactgttcctccattaagcgaatacagccctaagcataaatttggtttgttcatttaaaaatggtctttttttcccatcttatttctggctttactagggagatagattggctgaggttgtcacctaattctgggaggttaagagcctttgtcttttgctacccatttctgaaataaccagaagtctagcccatcctaactttcctctcgatgatccttttcttctttttacttcaaggttccagcccttcatttgactatcagtgctgttcactagttagccatgatccctttcatcctccgtgtctggattagaactgtatttttaatttgatgctgtgggcagttttgatagttacagatcctgtgatacatttaaatgtgtttacaaggggaacaaatgaaacaatgctgcatgaaatttgcctttcattttttttttcttccccttggagacagggtctgggtctattgcccaggctagagtgcagtggtgcgatgtcagctccctatagcctctgtgtcctgggcttaagccatcttcccacctcagactcatgagtagctgggactataggcacgcactaccatgcctggctaattttttattttggtagaagatgaggttttgccatgttgctgaagctgatcttaaactcctgggcttaagtgatctgcccacctcagcctcccaaagtaatgggattataggcatgagccaccacacttggccttttcttttttttatatttatttaattattttattttattgagacagagtctcactctgacacctgggctggaatgcagtggctatcatggctctctgcagtcgtgaactcctggactcaagtgatcctcccatctcagcctcctgagtagctgggactacaggcttgcgcccatgcctggctaatttttttatttttacttttttgtagtgacaggctctcgctacgttgctcaggctcatcttgaactcctggcctcaagtgattctcctacttggcctctcaaagtgctgggattataagcctgagccactgaacccagcaaaatttgcctttcttaaactaatttatctctgttgggtccaagagcttacaagttggttgtcatttaatatgttaaacactagaatattttttagttgaaattttattttttccctttacatattgtatcctttagtgctttatttcactaataagaattatagtatgcaatcatttcccacctctatattcagtatatcaatttttgtttttcctttctacttctgtcttttgctataatttgctgtaatacaggtactttcatcaaggcatccagttctttatatcattctatatttttacttgggagaaatagaaatgttgctaattccatcttactgacaatacctaaattattgtttgttatagaacataatgatttaaatatacaaaacactaaactgtttgagattttttacattttatgtgtgcagaatttacattttatgtgtgcagagacaaaaattgttataagattacaagttaatgtgcaagatgatttccgattcatgagtttcaggttttgatagcatatccttatccactagattagtcttttaaaaatgtgtatgatagggaaaaaatcgagggcatgaaattctgagacttatgggaactaaacttaaatgttcgttgttagatttttttttttttttttttttgctgcatatgaagttttaggcagtcattgtccaacaacattaaatactgaacatatgggaaaagcatatgatttttcaaaatgtttttctaaagtaatctcattctacatacacttaagagcagttataatgctttagtgacacttgaagtagctttttaatgtgatctcaccactatagggaaggccgttgcatgacttttttgtgtgtgcttaactgctaaacaggagaatcttttcctgagcaaccagttgggaaggatttaatttgacattctccctactaggacccccccaaagagactcattccctccaatagttcctacaagttctttctctttcctaaacttgctgttactaatttacccctcactgttttcaaggcaaagcctctgcaaggttttaagtcctttccccctcccgtcctgtccccatcagtgttgaaatgtatgctacagttattatggttgtaatttgttatgccatgttgatcttcttgtgcttttcatatcagaacaatgcatttttaacattctgactttctttttctctcaattggtaactgactatatagaaaatttatatttatggatactatttcttttttaataagttcaagggaaaacattgataaaggaaaatttatcctttcaactttctttaggtgccagcattattttcatattaggaagcaggagaaagttaaggaactctaagcaatactagaatggttatatatatatttaagtttgtattaaacctgttggaatggtaaagaaatttactgacatatttaaccatacaaaatagtgttgctaaaagactagtttttctctttattctgtgcatatgtatatatatgaatgtgtgttttttttaagaaattttaaaaaaacttaatctgccagcttttctctattggaatttgcaaacaacttgtaaaattggaattacagaatattagaatagtcagttatggaaagtcacttcattatccttgtgtcactaaacgtataaagttaaatcagaagtgtattaatctctgaatttctaatcagttgtttttagtttgcagaaaaaacttcagcatgtgccaggaacacaacctcaccttgatcaggtaaagaaaaaaaatctaaatctaaaattcctaatcaatgtttttaaaggacctctttaactagataggctatgtttaggactattttattataaactttttctaaaatggtatttttgaactgtgttgataatttttggaatcttaaatgcttttgacatagtctaattctatttcttaacacataataggaattcatcaaaccagatttgttttagaatctgaggaaatcatgctttctagcctttccattctgtagcttgcttagcatattggttagttctgatagggattactccttaaaagcagcctgggggttctataggcagtctgtttttaagtatgttgaattgtttaaggaaaggtctgatataagcatggcttatttaaataaaaattgacttggagtttcaccttcaggtagcactataaatttgaactccttaagatgtttttcatgctctaaaattctaatccctaaggtaaatatctaagatgctaggaacaatttaaatataattttactgtacctgcgtttctgttaagcagatcatagatcgtagagctttaggataacttctttgttcctcttaaaaccctgaggggtggagtgggggatgtgtaagtgagcagtgtgcctaatcttccttcctctctctcaagtgatcactcaatttttgaattgctattggttgtaatagggccaagataacagctacttgcatttgtattcattttggttcatatttatgagcaggtttgctactatgtttgtggcacctttccctgtgaaacttttgttaataggatattcctcttcacttatctttaaaatgaataaatgagagaaatacaagtccttggagatagaatttatggtaaaaaaaaaaaaaaaaacccagttctttatgatagtcggtatctgtcatatagttgaacatgaagcacatttgagcttctgggtaaagaacgtgatgccaagaatcatagggatgaaaagatgaagaaaacgcagtactcacttaccatgaacatttggagcagccagtgtctccatccatagaatctcgaatgaacccctattgtggcagttatgatgccttgtagtttggttgaaatgcttttgccttgcattagtctataaattccttaaatataaaatctttattgctcagtacagggcttggtggatactcagtgaatatttgttaaaagaatgaaaagctgtgtttctcaaatggggtataaatcagaatcacatgtggagcttttttaaaaaaaattcgataactcagtagttctcacccctcagtctccaggattgggacttgggtatgtgtatattaatgtatatttttaacattttattatggaagatttcaaagatataaaagaataaacagaatagtaaagtaaactccttgtatgcatcacccagtttaaatggcatcaacatttagctgattttatttcacctatcctcccaacatttcttttgcctggagtatttaaaaaaaacaaatgtattttaataggaaatttcaaacgtacataagagtagaatagtataatgagcctttatgtacctattgcccttggtgtagtgtattaaagcaaattccagacattatgtcactttactactaaatagggcatatctatatttttgtagcctctgtaggagattctgatgcactgtcctgctttagataatataaacatagggaaaaatagtatcacagccaaagggctatgggattcagaggcatgaacaatttcatttggtttagtggatctgaggtgtaagggaggaaatttatcttttcctcgcctatcactagattcatggctgaggtctctctaacagaagaccaactatcaagagaaatttcaacatagaaatttatttagtaagttttacttgacacaggagccttcataaaacatacctgtgtatgttttctgttagttatgatatggaagaggatagtaatggagaagcataattagataaaacagtatgatctaataataaactgggaagaacttagcaaggcctgtttgctcagatttttctctgtgacccttcatattcagacttaaggatgttcttttcctctgtgtatagagagggcacctcttaaatgagggtcttatgacctgcatcagcggaaggtcagaaaatctttcctaggttttatgacctgcttcaggagagaaggtgagagtgaccttcctgattctgccattttctcaaatattgagttgccatattttgggatagcatgtcctgaaccccatcaaatgcttcatgaggatagtttttcatttgtttcttttggttttggtttatttatttgcatacagtaaagcatgcaaatgtgtaattttagtgtacaattcaatgtttgggttttgtttttgtttttgtttttttggttttttttgagacggagtctcactccggctagagtctcacccaggctggagtgcagtggtgtgaccttggctcactgcaacttcctccttctagattcaagtgattctcatgcctcagcctcctgagtagctgggattacaggcatgtaccaccatgcctagctaattttttttttttttttttttttttttttttttttttagtagagatggggtttcaccatgttggccaagctggtctcaaactcctgacttcaggtgatccacctgcttcggcctcccaaagtgctgggattacaggcgtgagccactgtgcccggcctcaatgtatttttacatatatttgtacctatatatctgtctatatgcacattcaaacacatatccttctaactcccactcaggtcaagatacaaaagatatccaaaattgtaaagagttcctttttgccccttcctagtcaaagaaggggtaagtgctattctgacttacttaacaaaaaataaccttgaactggtaggattttttttgacggtaggattttttttgacgggaagaagtaaggaaaagagcaatacggatgtttaaaaatgagaaggtgagaatcttatagatgagtaggtctctggtacagaagtcttagtggagagttggtactggaatcctggtctaaggtattaggttttaatttgctagacaaagagaactcaagcagtgctgtctaggagtgttatgtaagctagattggactttagagtcaggagaccatgcgggaagatactgtgtgataagggcctgaaacatgttggttacagtgagactagaaatgggataaatccagagctgtttcaccagtagacttgcctgaatatcctgtctgactgattatggatcagaaagaaaagaaggggtgatgggaaacaagcctagattgactagagaaacctagaaatagaaaaatcgggaaggcaaagtgatttggatgataatgccatatattcagttgtccctggtggccagatattatagtatagatattatacaggcaaagaagaacagagggatagagtgtgaaggtacagattttgagtttaagcacattagggggcttagtgttctggatgaagaaaacatataaaagttattgtatgttaggtattgtttgcaaaagagtagaaaatggagaaataacccagtgggttaaagaagaaacagactaaataaacaaacctgagtaagttgttcctaaattttattttagaggcaattcctcattttgctttagttttctcaattattgcctcacttttctgtttctttctctgtcagcatacatggaaaaaggagttaattttagattcaaaacaaaaactggaaaaaaaaagtctgaaatgggtaatacctaggacctagtatatatgtgttattaaggctctatccctgaatttttaatgcagttatctatttttcatggattctttgtttattccccataaggaacacctgggtttggagaatgggaaggtagatgagaaaacccaagtgacaaagaatgtttagtttattattagaaccaactatgagttgtgacccttatcttctgcactgggaattacagattttttcagggtttttctaacgtgaaaagagtttattggtgtaggaaaacatctggttccaaaatatagatcatccttcttgagccccatgatgcgttatcttaatttttaaagccttttgtgtctcatactggagtttattgtaccccttaaaaatattaagtcacatatttaacctgataaaagcaaaaatcattataaaaatctttaggctgggtgtggtggcttatgcttgtaatcctagcgctttgacaggccaaggtgggtggattgcttaaaacccaggagttgtagaccagcctgggcaacatggtgaaaccccatttctgcaaaaaatacaaaaaattagccaggtatggtggcatgtacctgtaatcccagctactcgagaggctgaagtgggaggattgctttagcttgggagttcaaaactgcagtaagccatgattgtgccactctactccagcctgggcaacagagtgagaccccatctcaaaaaaatttattcagttaaaatctttaacaataaagcaattttgagttgtattttgcgacattctcaatatagttttccaacttgcattaaaatacattttaaacatttttgaagactaaattaatttttttaactgacatttatgtttcatttgacaaccttttgctgtatattttatgtggacttttaggtattgtagtgattcctttaatgaagaaataaaataattgtcatttaaaaatgcatattattattaccttatgctataaaaatagttttaaaatagagtatgtttattaagatttaaaaataagtatagtcatgcactgcataacagcgttttagtcagactgcataagattacgatggagctgaaaaattactgtcacacaaatacttaccattgtgttattatttccatacactgttcagtacagtaacatatatgctgtacaggtttgtagcctaggagcaacaggctatacagcatagcttaggtgtgtagtaggttataccatctaggtttgtgtaagtgcactatcatgtttgtataacaacaaaattgcccaacagctcatttctctttatgtatccatgactgtatattttttattgtggtaaaaaacacttaacgtgagacctaccttcttccacaaatttttaagggtacaatatagtattgttaactgtatgtacattgttatatagcagatctctagaacttttcatcttgcatgactaaaattatacccattgaacagcacctcccaattttcgtctccctctgacccctggtaaccaccattttactttctgatttgatgagttttactgttttagactcctgatattagtggattcatgcaatatttgtccttctgtgactggcttatttcacttagtgtaatgtcctcaagattcatccatgttgtagtatatgacaggatttttttaaggatacataatatttggttgtatgtatattaccacatttattttatccattcaactgtcctggacatttaggtggttgttagtgtcttgactgctgtgacaaaataagtacttttaaaagtctcacatttgcaagttcaatttgaacctttttttagtctgcttgcacttctcttatcaagcaagaaagcacttttctgctttttctattactagtaacagtggagattaaatatctcatgtttttgggcgttctagagcccaacacatcacctgttcctttccatactaccacaactgacactctctggaaagtgccacctccctgcagcaggccaaccagcacaaaaatagtacattaaaccagcaaagctaagaaccgtcaaagagtacatttcaccctcctaccacctccactggaacaggtgctggtatccacagctgagagacccacagatggttcacatctcccgactctgtgcagactaccccccagtaccagcctggagtctggtagacttgctgggtggctagatccagaagagagatagcaatcactacagctcagctctcaggaagccacatccataggaaaagggagagagtactacatcaagggaacaccccgtaggacgaaagaatctgaacaacaaccttcagccctagaccttctctctgacagagcctacccaaatgagaaggaaccagaaaaccgaccctggtaatatgacaaaacaaggttctttaacgccccccaaaaaatcacactagctcaccagcaatggatccaaactaagaagaaatccctgacttacttgaaaaagaattcactaggttggttattaagctaaggcatcagagaaaggtgaagcccaatgtaaggatattaaaaaaaaaaagatacaagaagtaaggggagaaatattcaatgaactagatagcataaataaaaaacaatcaaaactttaggaaataatggacatacttatagaaatataaaatgctctggaaagtcttagcaatagaattgaacaagtagaagaaggaaattcagagcctgaagacaaggtcttctaattaaccgaatccaataaagacaaagaaaaaagaataagaaaatatgaagaaagccttcaagaaatctggaattatgttaaatgaccaaacctaagaataaccagcattcctgaggaagaagagaaatctaaacgtttgttaaacatatttgggggaataattgaggaaaacttccccagctttgctagagacctagatccaaatacaagaagcacaaagaacatctgggaaattcatcacaaaaagatcgtcatctaggcacattgtcgtcaggttatctgaagttaagatgaaagaaagagctgtgaaacaaaagcaccaggtaacctataaaggaaaacttaccagattaacagcacatttctcagcagaaaccctgcaagccagaagggattggaaccctatcttcagcctcctcaaacaaaacaattatcagctgagaattttgtattcagcaaaactaagcttcatatatgaaggcaagatacagctttttcagacaaacagcgaattcaccactaccaagccaccagtgcaagaatgctaaaaggaactctaaatcttgaaacaaatcctggaaacatatcaaaacagaacctctttaaagcataaatatcacaggacctataaaacaaaagtacaattagaaaaacaacaaaaaccaaaaaaaacaaggtatacaggcaacaaatagcatgatgaatagagtggtacctcacatctcaatactaacattgaatataaatggcctaaatgctccacttaaaagatacagaattgcagaataggtaagaattcaccaaccaactatctgtcgccttcaagagtctcacctaacacataaggactcacataaacttaaggtaaagggatggaccaagacatttcatgcaaacggacaccaaatgtgagcaggagttgccattcttatattagacaaaacaaactttaaagaaatagcagtttaaaaagacaaagagggacattatataatgaaaaaaaggccttgtccaacaggaaagtatcacaatcctaaacatatgcacctaacactggagctcccaaatttataaaagaattactaatagacctaaaaaattagacagacagcaacacaataatagtgagggattttaatactccactgacagcactgcacaggtcatcaagacagaaagtcaacaaagaaacagtggatttaaactataccttggaacaaatggagttaaaagatatatacagaatattccatccaacaaccacagaatatacgttctgttcaacagcacatgaactttctgtaagatagaccatatgatagccaacaaaatgagcctcaataaattttaagaaaattaaaattatatcaagcactctctcagaccacagtggaataaaactggaaatcaactccaaaaggaaccttcaaaaccatgcagatacatggaataacctgctcctgaatgatcattgggtcaaagatgaaatcaagatggaaatgtaaaaattcctcaaactgaatgacaataatgacacaacctatcaacctctgggatacagcaaaggtggtgctaagaggaaagttcatagccctaaatgcctccatcaaaaagttggaaagagcacagacaatctaaggtcacatctcaaagaactagagaaacaagaacaaacccagcagaagaaagaagatcagagcggaattaaatgaaattgaaacaaaacaacaaaaaaatccaaaagataaatgaaacgaaaagctggttctttgaaaagataaataaaattgatagaccgttagcaagattagccaagaaaagagagaaaatccaaataagctcaagaaatgaaacgggagatattacaactgacaccacagaaatacaaaagatattcaaggctactatgaacacctttacatgcataaactagaaaacctaaaatagatggataaattcctggacagatacaaccctcctagcttaaatcaggaagaattaccctgaacagaccagtaacaagcagggagattgaaatggtaattaaaaaattaccaacaaaaaaatgtccaggactagacggattcacaacagaattccaccagatattcaaagaagaattggtaccagtcttaaagacactattccacaagagagagaaagaaggaatcctccctaaatcatgaagccagtatcaccctaataccaaaaccaggaaaggacataaccaaagaagaaaactacagaccaatatccttgaacatagatgctaaaatccttaagaaaattctagctaactgattccaacaacatatcaaaaagataatccaccatgatcaaggggtttcataccagggatgcagggatggtttaacatacacatgcgcgtagccaaagcaagactaagcaaaaagaacaaatctgaaggcatcacattacctgatttcaaacttatactataaggccatagtcaccaaaacagcatggtacggttataaaaataggcacatggaccaatggaacagaatagagaacccagaaataaacccaaatacttacagccaactgatcttcaacaaagcaaacaaaaacgtaaagtggaaaaaggatacccttttcaacaaatggtgctgggataattggctagccacatgtaggagaatgaaactggatcctcatctctcactgtatacaaaaatcaacccaagataaattaaagacttaaatctaagacctgaaactataaaaattctaaaagataccattggaaaaatcattctagacattggcttaggcaaggatttcaagcaaatgcaataaaaacaaagataaatagctgggactcaattaaactaaagaaattttgcacagcaaaaggaacagtcagcagagtaaacagacaacccacagagaaggagaaaatctttcataatatatacatctgaaaaagaacaaatatccagaatctacaatgaactccaacaaatcagcaagaaaagcagtcccctcaaaaagtgggctaaggacatgaatagaccgttcttaaaaggagatatacaaatggccaataaacatatggaaaaatgctcaacatcactaatgatcagggaaatgcaaatcaaaaccacagtgcgataccgccttacttctgcaagaatggccataataaaaaaatcaaaaaaatagtagatgttggcatggatgtggtgaacccagaacacttctacactgctggtgggaatgtaaactagtacaaccactatggaaaacagtgtggagattccttaaagaactaaaagtagaactaccatttggtccagcaatcccactactagatatccacccagaggaaaagaagtcattatacgaaaaagatacgtgcactcgcatgtttatagcagcacaattcgcaattgcaaaaacgtggaaccaacccaaatgcccatcaatcaatgcgtggataaagtaactgtgatatatatacatacaatggaatactcctcagccataaaaaggagtgaattaatggcattcgcagtgacctggataagattggagactattattctaagtgaaagaactcaggaatggaaaaccaaacatcgctgtgttctcactcataagtgggagctaagctatgaggatgcaaaggcataagaatgacacaatgaactttggggactcagggagaaagggtgggaaggggatgaggaataaaagacaaaaattgggtgcagtgtatactgctcaggtgatgggtgtaccaaaatctcacaaatcaccactaaagaagttaaccaacaccacctgttccccagtaacctatggaaagaaagaaatgtctcatatgtttctgcctaaattggtctttaatactttagcgattctcttgagtttggactataaaatagttttggtctttttgtattttctgctgtaagcctgtatgattatgtaatggtgagtaaaattgctaggccagatacgcagttctaggaagttattcaaagatgtgctttagtatattattttctacctttttaaattcattttgagcttggcttttgagcctctattttccaaggtgaggtgtatgtttttataatgttatgcttagcccttgtgtattttcatctctgagtttgaaatttggggttatattggcaaagggaggtttgggttttaattaggtgacctgttacaggaaatgttaagcttctgtttctttggggtagacagtgagagatttatcaagataaagaagaaaaataaatcctaaagttaatattcaatacatgatgatgtcacccttactaaagccaaagagggcattatcctatcattctcatcgctaagaactcttctcctcttggcacatgcttattcagttaaagataagccaagcctttcttttgtattttttttttaagagaacaaatttacttcggttttgagttttattcctggctctgggtagcttatttttttgacccttattttccccaatttataaaatgaaatagttatcttcactccccaggattgttgtgaagagtaagtcaaaagataaaatgaggtgactcaggcaaaagtacctggccctgtgtagtgagtacattgtatgtgttacatatattcttattgctgagaatccacgaaagaatgaattaaataatgaggaccctttcatcagggtttttgagtgagttttttaaaatacaaggtagtagtttgtgtaaatactaaatccattggtacctgtgcagaatgtaggaaatggagttgctaattccaaaaaaaacagcacatatgctgaggaaagtataatacctaatatatatggtttaagcaatgtaaaattccatgaatatgttccttttcatcttaaaatttgtgatttaaaaaacattgttattactataaagaattattattatttcccttgatttacagagtattgttacaatcacatttgaagtaccaggaaatgcaaaggaagaacatcttaatatgtttattcaggtgaatgcaatttttaactgattaatgatttatcaatggttttgttacatagttgttgctattagcgatggttggtcttattaaaatatgtcacttgatacagaatctcctgtgggaaaagaatgtgagaaacaaggacaatcactgcatggaggtcataaggctgaaggtacagtttactgttgcagacttttggacaaagtccttttcttggctgttataaaaactatatttggttttaaacagaaacactggttttagtacaaatcatctttgtctactttcatttttctttattattttcatgactgaaaaggagctttggaaatcactgcataaggcttgatttatttgcacaactttctttagggttgcagctagaacaaacctgtgcgctttgaaatgttaccttctgctctctgttcccaagtacagagaaataatgttgcaaatctcacttctgctgaacattatgcttcctgatgcatttagcagacactaaacatttgtcatactctaaacaaagttacaaaggactagaagaattcttgttctgtatttagaaacccactcacattacttgatatttgggtatttaagtcatgaaaggtatttcttctaggaagcagtgattctaaagtgtatgcttaaccagtcagttgagtgtctactcttgtgtgttcacaagtgtacacaaagtttttggtaaattaagaatattatttcaaataaattaatttcatccccataggagccagtttatcagataattcgtttctcatttctgcaaatcaatacacaatgagctcatattcagataaatataatagtttttctttatttcaacattgttcattgattgcaacccatttctaaaacaaattatttaatataaccaaactcctttaacttctcaacttttcccactaaaactgtgaaacattatataaaatctttaatcaataggatatgatacatatttcatcattttgtttcaggttttggttgtgataaaaaacactgaaaaaccatcctaatatatgtattaactttatcattagaaaaggggattgttcaaaaaaaaaacaatacacagaaaccttttttgaaaattaaaaacattaagaaacttcttgtaattcacaaataattgaaattaaataattttctcagcttaagagtttgtattttttaagtgaatatcagtaattaatccattaacattgatgctctatttctgcttttaagtttgaactgaggctgatcaatgttcaatcaattctcctttgagcagggattggtgtcaatcaaagacaaatcacaacaagtgattgtccagggtgtccatgagctctatgatctggaggagactccagtgagctggaaggatgacactgagagaacaaatcgattggtcctcattggtaagtctcaaaggattcacagttttaaaacaaagtgaaaaatatatttgaaagggatatcatgtgccacttaaacagattaaccattcaggtcctcttttaaaactaaataagcttgtggtcaatgtttcatctttatcatgttacaacgttcgtaaaagcttgttaggacttttgttcttcttcagttttagaaaagtggttaatccaaggaccaatgtgactttgatgtactgacctggaaagttaaagatggaatcactcaattactattctttttgtaaatttctaaacaccataaagcatttaatgaactggaattgataggtgaactgtgtcattttaataagcataatgtaatcacgtcatattttgttttgtttgcaggcagaaatttagataaggatatccttaaacagctgtttatagctactgtgacagaaacagaaaagcagtggacaacacatttcaaagaagatcaagtttgtacataacactagtggcatttcttatcaaaaggattggataataaaaataagtttctactgggtatatttcaagcatttatttattactttagttacgaattccaatatactttaaaatggtatttgttttacagcatacataaaatgtagcaaatcagtactgtaaaacatttaacattcatacaattatatataatatccttttttttaaagaatggtatttcacaaaaatatcttttgaaattggctttggagtttacatatactgaacatgaaagtttataataatgatgatacaactttcaacatcgtcattttttcttagaacttcagctgattgcagagatataatgattacattgttattaaatttttttaacacaagtaagtgtcaccattttatgacatgaaataaaaggttatgactgttattgatgttgatgttgacgacctgatcacctggctgaaggagtgtttgtcaggtttctgcattgtaaagttactcttctcccccatttcatactgtgctctttggaaggaaatcactatgcacagcccacactaaaggaatggggagttgtagtgtactttcttgggagtggtctacataattaattgaaattcttctgcaagggacagttgtccctttcgctttattagtttgatcatttatgtttatcagtgtggacacgaatattttatactttgggttacaatttaatactactttattttgttgctcaaattttcccagctttgaccattgggaactctttcagttatctcctgttcccccctttgacatacccccatcaatgtgggttttgtgttttgtttttgagcgcctccttatttttctcttgtatttttaaataaccccaatccctattgaagctggcgctaggaaaactaacaatactccctttcccaggtcatccgattcctatgctgatggaggaaatttgcctcacatgctggggggcgctggggaggaggcgtctgggattatgtggttgaataagacacctggcctggccctcctggagcttagtttagtaggtcacacaagcagtcattggtaaatttgggattcaaacaaatctgttaggctcaaacctgtctgttatttgtcctccaagcttcatataaactgaggagccctaaagggtaaaaacttcaggagcagcaaagtttcaaaaaaagatcagcaagaaagctcttttccagattttatcctgaaggcactagctactttaagctattttttattatattttgcccttgcagttggcgtttgatttctcactgaacattcattgtcataattatagacactatgtgactatcaagggcataatattctttcatgctgcattttttattagatggcacctcaaagttttcccaagtaggtgggttttaaattatgaatatataccgtggcatagtatcttacttagtattttaataagagccttatttatataacaaatatttttttttattcctctgtagtgctactttagtctctgagctaattttcatgaagccaatctaaaaatcgcgttacttctaaggatgtggagcgagtgagatgaacagttgtgctgtcatattgcccctccccagtgcagatagtgaatgaggacccactgatttaaaggcaacactgcagccccttcttgcctcattgaagtcccaagttttattacagtaaaagcacttaatgttgacatttctgaaagaatgaagaggccgggcacggcggctcacgccggtaatcccagcactttgggaggctgaggcaagcggatcatgaggtcaggacatcgagaccatcctggctaacacggtgaaccccgtctctactaaaaatacaaaaaattagccaggcgtggtggcgagcgcctgtagtcccatctacttgggaggctgaggcaggagaatggcgtgaacccaggaggcggagcttgcagtgagctgagatcgccccactgcactccagcctgggcgacagagcgagactccgtcccagataaataaccaaccaaattagctgggcgtggtggcgggcgcctgtagtcccaactactcaggaggctgagacaggagaatggcgtgaacccgggaggcggagcttgcagtggtcctagattgtgtcactgcactccagcctgggcgacagagcgactccgtctcaaaaaaaaaaaaaaggagaaaaagaatgaagagccagagccagagccaggcatagtggcacgcctgtagtcccacctactcaggaggctgaggcgggaggatcacttgagcccaggaattcaaagccagcctgctcaacatagaccctgtctctaaaaatgaattggttataaaggatgaagaaaggaaggaggaaagggagagagagaagcccttatagagtgggtgcatttcttgtatgtggggccactttgtaagaacaggatttttcaaactgggcccatactggtacgtgtgaaatcaacttagttggttatggccatttttttttaaaaggaaatatcagtcatcactatagtgtaagtatattgtttcgtgaaacccatcttagttatgtattatgtctgtatgtgtaagattgttatataaaatgtatttctgtggttaaatattcaaagaaattggagaaccattgctacaaggggacagaggactccgtgtgagctctcctgccttccctgaataaacttacacaatttagtgctgggacatttggaccttttctgaaaatttgagtcagggagagcatcttggggaggtgggaaggaaggtagaaggagcaaagcaacacccccctgaagcctgggaatattgtcagaaccttaaatataattcagctcaccattctgggtaaggacagactctaccaatgaaaatgggtgattaccagctgtgaaacacaaaaacatacttttacggttacacattcctttacaaacaaccgtgtacatttcagcctcctgccccaccatttcttttctccaggagggaaggctgcatgtcgaggtggtcatagaatgttgagtatcatactttcctacctcgcttttatttgcgcgggtttaaatgcgccttaacagaacccgtgcaaaggcttgccaactgtctggctgcaccggatgagtagagcatcttccttggtggcaggtgggtgcgaggaggaggggcctgggcttttctccggacagtgtttgcccagaagaccatcatccctggactacgttaggaggaagtggcaccgctccgaggtaggggaagaagggttataaaggggggagtccaccacacatggtcttgaagaagcttttataaaaggcaaaggcatctttgccggacgttgttgcaaaggagtagaaacaagcagacgaaaacatcccaaagggtaaccactagcgttcctgcttcttgcaacattcatcccaggcttccagctcagcccgccccaggccaggtgatcggccgccacatcccctgcgactgaagcacctgctcctccatgaacctgccaagagctgagcgccctcgctccacaccgcagcgcagcctccgggactccgatggggaagacggtaaaatcgatgtcctgggagaggaggaagatgaagacgaggtggaagacgaggaggaggaggcgagacagcagttcctagagcagtcgctccagccggggctgcaggtggcccggtggggcggggttgcgcttccccgagagcacatcgagggcggcggcggcccgagtgacccttcagagtttggcaccaagttcagggcaccgccaaggtctgcggcggcctctgaagatgcccggcagccggcaaagcccccctactcgtacatcgcgctcatcaccatggccatcctgcaaaacccgcacaagcgcctcacgctcagcggcatctgcgccttcattagtggccgcttcccatactaccgccgcaagttccccgcctggcagaacagcatccgccacaacctctcgctgaacgactgcttcgttaagatcccccgcgagccgggccacccaggcaagggcaactactggagcctggaccccgcctcccaggacatgttcgacaatggcagctttctccggcgtaggaagcgtttcaagcgccaccaactgaccccgggagcccacctgccccaccccttccctctacctgctgcacacgccgccctgcacaacccccacccaggccctctgcttggggcccctgccccgccgcagccagtcccgggggcctaccccaacaccgcccccgggagacgcccttacgctctgctgcacccgcatcctcttcgctacctactgctctcggcccgcgtctatgccggggcaccgaagaaagcagaaggcgcggacctggcgaccccggcacccttcccgtgctgcagccctcacttggtcctcagccttgggaggagggcaagggtctggcgtcgccaccgggaggcggatgcttctctttcagcattgagagtattatgcaaggggtcaggggagcgggtacaggggctgcgcagagtttgtccccgaccgcgtggagctactgccacctgctccagcgaccatcaagcctgttgcatccccaaaccgctgcccctttgctgcaagtgtccgccgccgctgctgctcggacaattttgcagcaatagcagcagcatcaggaggactgcgccaacggctgcgctcccaccaagggcgcggtgctgggcgggcacctgtcggcctcgtcggcgctgctgaggtatcaggcagtggcggagggctctaggctgacatcgctggctgcccctttgggcggagaggggacctcaccagtttttttagtatcgcccacgcccagttccctggccaactccgcagggccctcctagagccaggtgggagtggggagcgacccgcagctgctcactccaccttgcgcggcccatactgggcgtgtgcatctgaatcccgctggagagcaaacacgaacttctgttcgttcgctgcaaaatggttagaaagattacattcctctaagctggattacgttcctctaaaaaccacctgaacgtaaccttcgcagggcgtcaagtcatcttttcttgccttcggttgtggcttctatggctgtcccgatttgcacattgtcatctttgaagattagtgacatagcattcatcttctgttgtcaccttttccgtcattccctgtatgcctgatggacaggtttcactgaagttcagagaacagcatgcaaaattagctaccaattaatctttatgaagtgagctgcatttctagccacactgagcttatgttttagcaggaagcatttttgggaaatgtttatgttagagtttgcccttcttgacaaggtgagacataaatgtctactttagagacatgaattaagatgggaagatatttgggggaatcatttactcaaacgctaagtaataaaggtacacaaagggcaaattatactagatttctttcccacttgttttctatgtctcttgcaattcaccttgattcccttcagtttctgtttaatgtagaaagtggcattttcattattttaagcttctagcacaatgaaagaatttctctttttcatgaacaggatcataaatgaaagggaggaagagtgtcctatatcatatttattgttcaacaaaacactgctccacggcttcaattcagtttaaaaaagagaatttattgaacatttaacacatacataaaaggcagtaaagacaaatgagaagagggggggatattgaagtatacggacttcaatgctgagttttacatcttaggaagttactccaccttacagaggctcaatttcccctgatttaggaaggcgatgctaatgggtattgcataggtgtaagtataaaaatgttgtatttaagagaatcccacaagcttggtataaggcagaaaataaatagatgtgacatgaataagtagtttattacatttgtatgctacctgcggactagaggaagcaagaaaaacagccactatgcttgattagcattatagagatggtacaatgatggttgccagaagctggggggaggaagaaatggggaagtattgtttaatgggtatagagtttcagttttacaagatgaaacgaattatggagatggatggtagggacggctgcacaatgttatgactatatttagtaccactgaactgtacacttaaaatggttaacagagtacattttatgttatgtgtattttaccacaataaaaaaataaaataccttaggaacattttcatgaaaaagcccacataaaattcattttaatgcacgtgtttttgcatagctttctatttttctcttttctctttatattccaaattctaatcagagaagggaatcccctctgtacctccaggatattcagtaaagaccactggaggttcatgccctagtgacagtgctcatttagctccaaattacagatggctctagactaactccacaaagtttaaagagaagatttaaaacaacaacagacaaatacgcatcctgaagttactgaactgcctgccacaacactgttcaaaggtagccaataaaaatctagatattcaatagcataacatcaaaatacccccccaaaaaaactctgacatgcaaagaagccataagatatataaaattaagatatatattaacaggataaaaataagtcatttataaatgacagaaaagaaggaaatttcaaggtccttaaagtaaatatattttataaatacatatagataaatacatgtatatgtcaaggtacttaaatgaaaattgaacatagcagaaaaatagaagttataaaatgaaaaatgtgacatgtatagatgaaaaataaatatttgaaataaaaattccatgagatagaatgtcatggattttaccctaacattagaaaatttatagaaaaaaaatagaagctttacaaactaaagtacaagggtaaactaaaataagaaagccagaaactcactgatacgtcagacaacatgcagcagtgtaacatacatgtaattaatgtctcaaaaaggatgggtgggggaattatacatgaataaagaatggtacactcattcctgagggcaccgaggagtgaggatagctttagatttgtaagggagggtattatccattcaggaaggtccaaccccatgaacaaacacctcccagtaagccccacctgcaacattggggatcaaattttaacatgagattggaaggggcaagcattcaaacaatagcaagagttaaatttcctttttaaaaaaatcacttatatgattccatttcgccatagataaaagctagtatttcagcctaccattgagtgtgcttatagctcaccaaaagggcactctgtctcgggaatacagatttgcctacaggtatcctattgcagtcaaagaaagagcaatgagggatagaaaaggttagtgatggagacaccaacgctgcattttgcaacaaacaacgtaaaaattttacggattggttctgctaacttactacagtttacattcctcccgggggagaattgttgcgttttttcttaagatagaaaagcaattcagataatctgaaatctccccaagaaggataagacgcacagcagaaactattctaggcaggaagtcaatcctttcaactgtctgtgctccatagaaacaattgtctgcactgggagtcatatgaggtacagacaacagccagaactctgatcctctcattagtgatttcagaagaaattaccagtcaactgagtaattcactgagtaaagtaaacatttggcactgaaagaggttagacggataactatttgtatcaccatattcatgaagctggaatattttccattactggtatcacatccgaatggaagatgttaaaaggtctctcatcttgtaagatggatatgaaagaacattttctgataaatgaaattattaacacacctgcgaggtggatggaagagaaaaaaaagaataatcagcttgagttcttctccttgataagacaactcactaaaaacataaagagaaaaatacaagtttaaaataattaaccagaagaagacgactctagagtttttaaattgctgataagattttaatttgctccaagttgaaaataattatattgcttgtgttttaaggcacataatgagcaattatatcacacatgatagtttcagcagtaaaatattatcagttaacagctggaactcataaaagcatagcactatgtgaagatggaatttgctaaaataaaccatctgctgaaaactactattctgcaaatttaaaaataaagtttaaatgttatttgtcttatttaataggtctgtgaaaaaatgcgctctttgaaaagcagctgctaccttaattaattctttatattagacggctggttacagtaatgcacagtaaggtgctacatagatatattgctaaattatctgcatatactatgtatttggcttaaattatttgaaattttatagttaaaataacaaatgtatatttaaatgttttgacacaaattgcaaatatacctttaaaaagcgtcttacactctaaatattatttgtcacatatatatttgtcttttctctataggaaagtttaaatttttcccttgaaactttaattatttgagtctataaaacaaaccaaaaatgtacaaattaacaggaaaaaaaggtttacagatatgtgcacaagtatgcacttggagtttacataatatatatatctatacacatatttgtatattataaatagatatacaaatatatactatatatataaaaactccaggaaaggcaaggtagtcaacacgcctatgccgtcttgaggttacagaaaacacagagctgtaggttggtaaatcaggctttgcggaagacaggtgatgacaaggaagaaagaggagcctggtagcagaggtggtcttgttccatggatgaaacctcacagggagcagccctcctcttgggaagtatagataggaaatggtttttagaaatgtaaacgtgccaggctcagttaatctttcctaaacccacacaagggagtatctcaggaaaagactgtctatatcaatgcagattttctctacaaatgcaaatctccccaacaaacacagcttttcagctattcttgtagaagaagctatctccagtcttccgagcagccatcttgaaatatgtcaaaaagctgcccaggcgcacgcctgtaatcccagcactttgggaggctgaagtgggtagatcacctgaagtcaggagttggagaccagcctgaccaacgtggtgaaaccccgtctctactaaatacaaaaaattagccgagtgtggtggtgcatgcctgtaatctcagctacttgggaggctgagctaggagaattacttgaccctgggaggctgaggttgcagtgggccaagattgtgccattgcactctagcctgggcaataaaagcaaaactccatctcaaaaaacaatgtattttagggtaatattttcagtatctttacctccatatatacaataaatattattgtgatttttaatcttttttgtggaggaaacacaggtgtgatttctagtgtagctgaacatcgtttatttgacaatattgcacttgtgtgtgggtgtgtgcgtgtgtagctactctttaattttgttctcacataatgattagatattaacaattaattcagtaaaatgtatgttttgcaatatttctccatgttatcatgctttaaattagtttaatcatgcccctataatgtgtacattttaacctttgactataggtctcaatcttactttggttcctgtatttgaatttatgctaataaagtcctacagctaaaaaagattatataaacttatctacatttttactagtattctggtgtcattttaaattatgtaataaaatcaaattttaatttggattattcttatctgagttaaggatctaaatttttaatattcttataaatattacataattatttctgaaccatatattgactaatctgccctttatatgatgtgcattataagagcttgggattgtttcatttgcaaagatgaatgcttgagaagtagatatttaatcataacgtttcaaaatctattggataacttagaattgaaaaatagcctataggttgaaaaactcctgtagtgaaggaagaaaataactaatatacagtgacaatataaatattataagtatttattttattatcaccctgaaatttgataatacaaacatgtaatatctacatatcatccatatatcatgtcataaaaaatcaatacattcttcaaaaatttagcataacagaaaatgaactctctctccttgatggaattaagttacaaataaaagtaaaaaataaatagataagtagatggaagtagatgtttgaaaacaaagaaaaatacttgttttggataacataaaatctcaattgacaattccaatatttccagaactttgcctgtcaactggtggagagttttccccaggagacatttgtcaatgtctagtgttattgtggggatgtcaagactggtggaggtgtgaaatttagaggtcaaacgaaacacctagcattgctagggcagcctcccacagcaaagaatcctctggtcctaaaggtaagtagcaccaaggttgagaaaccataatctagacagtaaacactacgtagctattccaagtgctcaggaaaacacatcagtgccctcggggggaaaagtgtgaacattttaattgccgtacatggtgacacaaatccatgttgttaatctaagtggaaggggctgaagcacaaaacgtaattcaaagagtttacttaagccaaaatgaggacagctgcctggaagaaacagacccaagtatccttggatatgaactccctttggagctttgcaacaagcagtttcttaaaggcaaaaaagggtccagaagtgggatgatgcaaagaggtttgtcacaaattctcattggcttatggaaatagcatttattagtgactggctatacactgttacactattattgggtgtggattatactatctggtgtggcgttattggttaattaatagctactgtggcaacagcaagcagcctagatgaacacacagctcaaagaggagcaggacagaactgctgtctcatttgaatatctctctgggcctgattatttaaaaggacttgcatttctcacatgaaagttattttcttttctcaatgtccataaatgagaataaatagacgtaaaatagatcttttcgaggatgaagtaaatggaatgaaaaacaaaacccaagctgaccagaaatcatagagggaagaaaaggttataaatatatggatttgtcagagtgattttaagctattaggaatcagttaaatgttgggggattttgtctgagaatgggctaaaggagaatgtcccttttgccttctgaagtttccctgaaaatcactaataggaggcagataaatagtagaaaaggcatacaggtttctgcaatgtgtgtacactggagccattagaacgaagacccagacacacgatgcgtgcagaagcttatctaccacatgaagtttacagaaagaatggggtcttggatcacaggaaaaaaaaaaaaggttatgtgagaaaacgaccctggctagcaacagtggactttttacataggtgaaacctcactgggagcagtcctcagaaagaatagacagaaaatgtttctttcagacctttggagacctccgatgctcagttaacctttcctagatccagacaagggggcagacctcagagaaagcctggctgcatcaaggcagattctctaccgatgcaaatctccccaagacagctttgcagctaagtttgcattcccagcccttctcaatagccattttgaaatatatcaaggaaatatatttaggggtaaaatatattagtttccttcatacagctataaaacatacaggaataatttttgtcaatgtctactacaaatccaatgtagcagtaattataaaacccactagatattgaagaaaaaatatgtagagtacatcaattacaaatgttgatactaaaatgccaaataaaataaaaataatatccaacaatgtttgaaacagtaagacaagaaattggcaaaaaaaaaataaaacaaatatccaccttggggatgaaagtgtgtttccaaatttggtaatccaataatattaataataatattgattagcccaaattaaaaataaataggggattctcagtacatgctagaatatatttgttaaaaggcaatattcatgtctgtaaagattttaaatgctgtaaagagtctgatattctatatgcaaacgtgtgtatgtccattagaagaagagaggcctgattttcatatgttactatatagagatagagaagtgggtagattaatttgcatatgcatagagaaagcataaaatagaaatttactatcatattaaaggaattttaattcaacaataaaataattcaaaggtaaaattttaaatatttttaacaggtacattattaatattagataatatttatgataattgtgaaaatattcaatgctaaaataagatacaatgtctaaacatcagtattaaaactagtataaatatttgcttgtttgtacaaggaaaattcaagctcgacctaaaattatataggaaataaaagaaaaattttaagggagctctttaataacataaacatatatatatatacacacatatatagcatgtatatatgttatatgggatagatatagatttaacatgttatatctatatttgtatctataactacagctgtatgtatctacatttctatatatttactcagtgatataaatatagactggaataaatataaagacacatattattcttggataaaaaggatttagtatcataaagataaattatttccaaattcacttatgaattcacaacaatatacagtttcattagtataatttaaaatttttaaataaattccaggattcatttaaaggaatatacatgtatacaagcagtcaagaaagaagcaagagtgcactaaagtaacttgctattgaaatacatttttaaacttagtaactaaaactgagcagtactgatttggagtactggaatttaggtatatgggatctcaaaagcacagagctcaaaggagacccctgtatgcacgagagcttaggatgtgctttggaaggcattaccaaaccacgggcaaagttactttagtttcttagtcttactaggtttgaaaagccagagaaaagactcaagaccaccatataagaccaaaacaaaaggacagggagagaatgtgaagatactgaaacttttacataaagttgtataaaatatcctttaaagaaaatgtaaagtttaggatatacatcaaaatcagcagaaccactaaataaataaataggcattgtaaaatagcaagagaaaatttaaatggatttctaaaaaatattgacacctatgatttttaaaatatgtttaagatatcccgtatttcgcagggcagcctttcacaacacagatatgttaggacataaaggttcttctgtttttaatttactagtgtttatagggtaacaaatgtcttctacccttgtcttttgtctgatggtgcaaaaaattttcataagcatgtatttctgaatgcctgatggattgacatatataatatgctgctagtattaaaatatgtgacggaaaacgcatccaatcttctcactgtttacataaattctaggtttctcctatttacctcaagcacgtatggagcgaattcttaccttttaatattgccatggcattcacattgaacataagttgaactctctcatatggtagctgggttcagattcccttgacaatttccaattctaaccctcacagttcctcagtgtggctggcctagatattgaccctacacagttgcctcctcctggtgactaccagctatggaaccgttggatacaacctacctgactcaccccacagacctcacagcgcacatggacagcccccacacgccagagtgacctgctcggttgcagcgggagtcaagaaatgtgcctgctggcactcaccccacagactagtgccccgtggaaaacttatttgggtaatgttctgggccgaataaaggctggagtcccacagaccccttttctctctcctgctccccactcatcttccccattttgttcagccctatgaggtgtgctactgtattagtccgttttcacactgctggtaaagacatgcccaagactgtgtaatttccagaagaaagagttttaatagacgcacagttccacatggctgggtaggcctcacaatcatggtgcaaggtgaaaggcacgtctcacatggcagcagacaagacaagagagcttgtgcagggaaactcccctttataaaaccatcagatcttgtgagacttattcactatcagaagaacagcatgggaaagacctgcccccatgattcaattacctcccacctgttccctcccacaacatgtgggaattcaagatgagatttggctggggacacagctaagccctcttctcagctaccctcttctctctggatctgtgagtaataaacctacttctgtgatttcccatgtttggttctgtggcctccatgggtctgagctgacctacactggaacctaactctcctcctggccagggtctctgagagtggctcttgtcagaaatacacaggacacaggtcaggcaacagtcaccaggcatctcctagtctcaacagatgttctgtgagagggaggcttggtcgtgggatgcacatctggccactgctggggtaaggaagtgtcctgtgaaaggcacatgttaagcatccacaaccccctgaccagaaccccagaaaggcagggctccaattcacagtcactctccagagacaaacctcaagccctaactggaggaaaagaaaacaatgtaaaaagttgaatttatcttactatttcaatgatccagtaaagacattctatgcctgtacaccacatattttcttcgattgtggatttattttagatagaattttatgtctggctttcactttagcctggtccctacctcaagcataaggtaaagattttccatgggttcttttctgatactactatctgccagtgtggggtcatgtcctagtctatcttgagggaatccccctgttcattattgtcagagtgagactgttaagtcttgatttccctggacaacttcactgcatgacttttaatatgattttttaatattccctttactggacaataaattatatagttatctgagtaagagatatggtcaggaagaggcattgcctcattcagcttttctctttggtgaactcgcatatgttctcctcacccgccagtcacctctaaaccgtattgttccaagacaacaaagagaactcgagtgtgtatctttcaccactggatttgtgtttgctccataaagcttcatgcttaatagggtttctgttagcattttctctgtttattttcccataaaatatcacaggcctttttcatatggaattatgggtgatttccttcaatttgcatcatatcaagttgaggttcatgttgatgaaaagtaaaacatacattgaaaatatcagtaatgatgttttcccctcctttttagcaccagtgcttgtgatacaagcacattttaatacaattgtagtctcatgctttgatcattcctatgatgaaaataacatttttagataaaatatctgagttttatgaggcctttagtatgtgatgtgatagaatatcagaagaccatacttttttctagttttctgtgcaattctatcattgtttcatctttactcctaccagagtaattttccaaaatagatatcttgtcattcttcctcttgttatcagtaaataagtgaaatgaaaagctagattatataatttatctagaacaagaaagtagaattgaatctacattcattaatgagactaaccagtcaattacacagataagcattttacatgttgaagatcatatggacccattgtcagaaatattattatttatgtctatatggacatcacctgtgcatatttacatagaaatcaatgagagctgatttttatttttattatatatattttttgagatagggtcttggttttttgcccaggctggagtgcagtggtgcaatcactgctcactgcagcctcaacctcccaagctcaagcaatccttccaccttggcctcccaaatagctaggacaacaggtgcacaccaccatgcccactttttatttttttaacttttgatagagactgggtcttgctatgttgcccaggttgcttttgaactcctgggctcaaggaatcctctcatttcagcctcttcaactgctggtattacaagcatgaaccaccatatgggccggaagctgatttttaaaatactgagatcatatagacgacaacacctgaaaaatagacaacaccaagctttatgttaaaaggtgtgagggtatcaatattgttgtggctattggggaggaaaacattagtaaaaccagtgagttaaagctgttgctttaaactttggctttaatttaacaaatgttctatggagtgacagtatgtatgtaaccatgctatgcccattcacagatgcagtagagggaagaatttctcaaagacaactgttctaagactcaaattaaaccgtactgggtttgaaaagagaaagtccagggattaccaaatattttagatatcagataaaagagaatgccagatatgcgatgataatcagcaatggttgttcacacaatacatcaaatcagtatttgaattagcttttgaattacaaggacaaatggaccaagtctagactccttagtagataaatcttattaggctgagatgtgttttcccctgtttttccacaaggagattacaaatttgcaaacctcagctgctctcattttatgctctcaccaagctaaagctgaagttcatcaatcagtgtgtctaagtgttcactggttatataccattttgtagtttcagctatctttccagcttcctaaatcatcaccttcatttgatcttgtttttttccactatcacttctttattgaccatataaagaatataagtgagttcttattttgttattgttcattttagtctaatttcatcaaaatatcacagtcttttaatttcattttaatttcaaagattaaatgaaacctacatagaaatgtgtgtaagatttgcatttgcattattttggcatcaatttgctatcctccctcatgcacatagagatcatttccacgtacgtgatttcaaacatccaagtgcagtattaaaagcagttgtaaattatggttctcattttcatgatacaattacaatataaacttcctcttgctgctgtaaccaattaccacaaacttcatatcttacaataaagtgaccgttaatcctacagttctgtagttcagaagacttgaatgaaactcacagggctaacatcaagttttgggcagggctgcagtctttctgagggctatgtggcagaatctattacttgatttttttcagcatccagaggccacctttattccttggaacatgacctcattcttatatcctatttttcttttttttttttttttgagatggagtctccttctgtcacccaggctggagtgcggtggcatgatctcagctcactgcaacctctgcctcccgggttcaagtgattcttctgcctcagcttcatgagtagcttggactacaggcacttgccaccatgcccagttaattttttgtatttttagtagggatggggtttcaccatgttacgcaggatggtctcgatctcctgacctcgtggtccacccaccccagcctcccaaagtgctgggattaggcgtgagccaccgcgctgggtcctcattcttgtatcttaaaagtcagtgatgttgagtaatttctcatgccaccacctccaaggttgcatttcttctgtcttcttctttcacttataaggaagtttgtgatttcattgatcccacccatttaagacaatctctctatcatttttccgcaaccttaatttcacttgaaatctaatttcacactgccgtgcaacctaacatatttgtatgttagactctgggaattaggacatgaaaattttggggaggccattcttttgcctgcagcagacataatctatttacctgcagattaaagcgttctttatttttctgtctccctctcttaattttttaaaaataatatgaattgtagtaaagagaaagaaaagaaaacaaagaaagaaaaagaggaaggaaataaagaaagaagaaagaaaagaaggaggagatgagggaaggaagggagggagggagaaaggcaggaagggagaaaaaagaaaacatgaacacaagaaagaaagagggaaggaaagaaaagaaagaaagaaacagaaagaaagagagaaagagagaaagaaagaaaggaggaagggaggaagaaaaggaggaagagagaatggtaaaagggaggaaggcaaagaaacaaagaaaataaagaggcgaaggaaggaaggaaaaagaggaaaggaagggagggaggaaggaagaaaaggagggcgggaggaagggagaaaaaaggaaagaaaacaagaacgtgagaaagaaagaaagaatacgagaaaagaaggaagaaaagggagggagaaaggaagggagggaggagggaaggaagaataagaggaaagaaagaaagaaggaaagaaggaaggagaaaaaagaaaagaaagaaaggaaaagaaaaaagaaaagaaaaggaagaggaaaagaagaaaggaaggaagaaggcaagggaagggaagagaagacaaaggaagatggaaagaaggaagaccgcaaacattagaaattctgtgtttgttagagaatatgccatactgtttttttttcacttgaaaggaaagagtagctgccattgaagattggatgtcttgttggtgatattgttgttcttatcttccacatgattactgagtttgtgcctagtctttccattactaagacaaaagtgttgaagtctgcaaatataattttggatttttctagttcacctttgattctttcatgttttacctcacgtatttggaggctctgttgttagctgcataccctaattagtaggatgtttacatcttcttgagaattgattattctattatctattatctctcatctctgatactatttcttgttccgaactctgttgtgtctaatatcaatgtagtccttccacagccttattttagtgtttccatgatatggctttctccatatcttgatgataacctatttatatctctatatatttggagcaagatataaaatttcgacttgattttttaaagatttttcaagatggaattcttatttctttttgttctatttgacattctctgagtttcctatatctgaagtttgattttctgtcacttcttttagaatatttttggcagttattttgaaatatatttcttttgctccattattttttcctcttttctttttgggatttcaatcataactagagtaggcaatttcatctcagtcttatgcaggtacattttctcagggtctcaggaatgtagccttctcacacttctgttcttttcctggctgtgttggtgagctcagtgatattcctccttcacctttaagagcagttttgttttgtttttcctgttttcatactcccagcatcaggagtattctaagtgtggcagtttttgttgccttcccctacatattaagtggaatatcttggtctatttggacccttataacaaaataacataaactgggtgactcaaaaacaacagatatttcttttttcacacttcttgaggctgtaagatctcaggtcaagatgctcacaaattcagtgttgatgagagcccatttcatggatcatagatggtgccttctttctatgtcctcacacagtggaagtcacacaagaactccattgagcttcttttataaaggcactaatcccattcataagggctcggcccccaagacctggtcacctcccaagtgttctgctctccctgatctgtgtcatatacagactctcttggattccttaccaattgcttgagagatcacagtgggtttgtggggaaaaagttttcaagatgatggatctttcccaacttctgcaactgtcagcggtctcccaatctcaccagccccactttgtctttaggaatttattgattattccagctttacttgtcatagtggtgtctatttgcatctgtcctatgtaagtgcatctgtcctctttctccttgcaggtgcttgttttccctcacattttgactcagttcttggcaacctggttgctctaaaaataaagtcatgactttgaagttagtttggttctttcattgttgtcaggttaggaaccctattccatcccagatctccaaaacccagactttttggggggttgaaatgttaggctttctctttgaattgtagttttatcttctttcagttaccatttgcattttcataatgattaatgagactaagctttttttgtgtagttgactgtacctttggatttttttcccaaatacctttttatttcttcttttctttatggttttagaaaatgtagtttacataattgcagcttgatttgttactcagttaatggcatgcttaatggagagaaaaaatattaaatatatttccctttttaattactgtgcttttttcttttttaaggaaatgtttcattatgttaaatttcaatgttattctacttagctattccttaaatattataatattttggatttcacatgtacatttgtaacatatcttgagtttattatgtatagagtaaggctattttcttttttaaggtaaaaatcacataatataaaattaataacaaccattttaaagcatacaatgcacttgcttttagtatattcacaatgttccagggcaatttcatcatgtcccttccaaaaacccattatgcataaagttgttacaccctattctgcttccctgagccctaacgaccactaatctaatttatatcccaattgatttgccaattcctgatgtttcatgtgaataaaatcaagtaatatttgtccttttgtgcacttaacataatgctttcaaatttcacccatattataacatatataagtacttcattctttgttatagctgaaaattaggtgtccatttatgagtcaacaagcgtatggattgtttccactttttgactgtatgaatattactgctgtaaatattcatgcacatgtttattttttgagcacctatgttttgtaagattaacagctgacttaagagaaacaatggaaggcaagaggcagtagaataatatattcaaaagatgcaaaggaaaaaaaactctcggccacgaattccttatccagcaattatttttcaaaaatgaagataacacaaagacttacccagataaacagaaatattaactgaagttgttgctggcagacctaccacattaaaaaaaacgctaaaataaattcctaaggctaaaagcaagtcacagaagacagtcacttgaatccacatttttaaaaaagtactggtataggtaacattgacattataaaagacagtaaaaatgcattttttctctttatcataaattgtttattaaataacatgtgtataatagccgggcacgatggctcacacctgtaatctgagcactttgggaggccaaggcgggcgtattacaaggccaggagatcgagaccatcctggctaacacagtgaaaccccgtttctactaaaaatacaaaaaatgagccgggcgtgatggcgggcgcctgtagtcccagctactcgggaggctgaagcagaaaaatggcatgaagccgggaaatggagcttgcagtatgcggagattgtgccactgcactccagcctgggtgacagagggagactccgtctcaatgataataataataatatgtgtataatgtattgctgagtttttgacatgtagaaatgtaatacgtctataacatattttccagtaacatcaaaaaggaggtagttggaagaaaaatgtattgtgataaggtaatcactctagatggtaaagtaataattactaaaatgtattgttggctttgtaactttaatagatgtaatgtgtaaagtgataatactttaaaatggaggaaataaaagagatttatataagaatgatgtttctatgtattaccagaagtttactagtataaattggaagatgatttgaataattaattttccatatacctatatggtaaacttacaacaacaacaaaaattctcaaaaatatataataaaataattcattagtaatctaaagttccctattttagaaaatattctttcattgcaaaataaagcaataaagaaaaatatttgagaaatatataaaacaaacggtaaaatggcagacataaatagaattataccaattataatcttaaatgtgagcagattaaaatccattccagaggcagagatagtcagactggattaaaacaagtgatcccaatatacgctgagatgcaaggatactaatggattgaaagtaaaaagatgacaaaaaatatcatgcaaagagcaatcataagaacactgaactcattatactcataacacacaacatagactattaaaaatgtgaatagaattttaaaaattatattgtagtaaaacgggggtcaacgctttaggaagacatagctattacaatcatgtatgcacagatatgagctaaattgtttcctttatatagatgctgaaattctaaccactgaatatgacctcattaggaaaataggttctttgcagctgatcaagttaagatacaatcagatgagcctgaattcaatatgactgatgtccttattaaaagaagagatttgagtagagggagacatacacacagggagagtaccatgtgattatgaggacagagattagccaaggaatgccaaagactgccactaaaccatcagaagcgagaaacaaggcacagaacaggctttctctcatagcccttgaagggaccatccctgctgacccctcaatctcagacttttagcttccaggactataagactataaatgtatgttgttcatggcacccagtttgtgttacttggttatggcagccctaggaaactaatacatgaactaataacaaagcataataacatgaagcaaaaattgacaaaagaggagcatcagcaaaatggcagtggagacagctgcaatctttcatttccccacagaaacatcacacaactaagagaaactgtccaaataaactttgccaaaactctggaaaacagtcaaaagattacaacaaccgagtgaaagcagactcaagaaaaagacaacttgaaaactttatgacatttttagcttgcctttgccccagcaaattggcagttttgaagtgtcagaagcccacgttcccagtgaggaacactggtctatggtccaaaggaacaagagaagatcttacccgcaaattactatgtgtctgttctgactggtctgggggatacctaaaggactcatgaaaggcttttgtttttctgtgttgctagaatacagaacagataaggaatggacattatcaaggaactctgcaaggagacctaacaaaccacagatgcttagggcaaaaattagagtttacacatatagtagatcaccttcagcacaggaagaaaagttggagaagagtatttggaaaactaagacattcaaaattattcacgtacatgggagagtctagaaagtcacatgtatgcataggttaagccacatgctgacaaatgtcataagaagaccctacacttttaccttggccgatccctcccctcagtgcaagctctgtgcaagagtgaacttgaacttcactcagtgcaagagtgaacacacactttgtgccggctttaaagaacccagcacaaagccagtctgcatggcctagaagcatattttgctggacaatgattacttgtttttctttttgtttttgttgtatttgcctctttgcttacttcctgacatacaagaaaatcactgtcaaaacattagcttaacatttgttaaggaaacaaaaagacttcggtgaccacaccttataaagcaaacagttttgtaaatcactttggaaaatttcactaaaaaaaaaatccttaacaatataataagtaaagaaaatttaaaaccccaaaacattactgtgtttgtaggggagggtctgatttacagagtaaccacatagtaattataattattataatgcccagttttcaaaaaaagttacaaggcatacaaagaacgggaaagtatggctcattcaaaggaacaaaacaaactgacagaaaatatttctaaggaaacccagacttcaaacttaccagacaaagactttaaaacaactctcttaattatactcaaatgtcgcaaggaaagcataaacaaagaaataaaggattcagaaaaaatattaaaaagtaggaatatcaacagagatagcagaaattctggagtggaaaactacaatgataaaaatttaaaaatcaccagagggatttaagagtatatttgcacacacagaggaagtcatgagcttgaagataagaaaatggaaaatattgactctgagaaacagataaaaaatgagcagagactaaggaatctgtgggacatcatcaaatagaccaacgttcatattctagaaggataaattatgttgttgaaaactttagcattctttcttttcaccttcctccctcttcctcctcctttttacttttcttcctcttcctttctcttcttctttctctccttcattatccctttcgctctgtttctctttctccctttctctttttccttttctttcaattttctccattactaagagatgtttgaatacccttaccatgtgagttgatatggttatttctccatttaatcctcttttgagatttatagtctctctaagtaaagagataacccaaacataagcctcacaaacaggcttccataccattcttaatttggtcctgtaattcttcattgctgtattaactttctgatgcttttaaggatgttttacaacaaattgtttagttttttccactggaatgtttattctcaattatctaattcatactgtaagtatagagggagtttaatataaaattattaaactaatatttgtgaaagaacgtatttgtgcatttaacaaatatgttaatcctcagactgttattgggcagctgagcatacagcaataaaaataacataatttttatgtgtacaatatttatggaatacgttactggaacaaataaataatttagttaataacatgacaaagaacagaaattgtatacactatagagcatagtaatggaataatgattgaagttattaatattaggtagaaaatgaagggtatctttgagagcagaactcaaggaaacaagcaattcgccttatgaggaaagagttacctgtggataaaggagaaactgaaaaatttacaagtcaagactttttgtgcaaaaacaaaaatatgattattagtcaccaattcagtacagtgaaaaaaaagttgaagagatatcttggaagtaaaccatattgtggaagagcatgtagggttttgataatcaggggattattctgaattaattttaaatgcgataggaatatatgagataacttaaccagagaataacatgattgtgtttgcatttcaaaggggtgtatcttgtgcaccgtgtagaataaataggttttgtgagcaaataaattgggaggctactctaatccagagaaaaaaggtagtgacttaggtgagaatgctgtcaggatgagtggtagtagtggtgagaagtcattaggccatggatgtatttcataggactagccaagagaactgcagctaaattggagtgtagggagtcaaatggagaactcaaagatgactctcagcactggaaagtgacactgaagcatgctgatgcctcttattaagagagttacttgggaatggcaagatcaaaacttctcactttcaaatttatgaaaaatattgttttcagaacgaatgactttgggatcagaaagccatcattctaattgatggttccaagactacacgggctcacactcccaagaacaaaagtaaatcatcacaaaggtgcttcctgataattctagagaatggagaattactgtaacatctttctgattttaggagaggtagcagttccccgtttagcctaaacgctatttttttttaaagctcagccaagagactccattataattttcaaatgtgtgtaacttaaattctcatatgaaataccactatgcttaaattagtcaaaacattttccccatctacaactctatcttttcattgcaatcattttcacaaaagtgtctgcagctcacagaccctaaaaggagaaaatccagggtaggttatctgatctagttttgaagacaggatctagagattatttaatatgaaataggtcacctgaaatgaagtgtttcctgaaaacagcttggatcagcccagttttctaccactgaaccatgcatttggtttaaaaaacacaacaactctggggaatatcggctgcttccaactgtgttgaaggtgttaaagaaaagagcataaaagtaaaaatgatcatctgaggcctttatagtctctgctcaagagactagagtcttccattcttaacgaaacacccaaatatcttaataattgggcaaaatctaaatatcagagagataattttatcttgaagattgttaaattataatggtgattcactaccttgccacgtctctgagtcaaaaattaggtctttgtttaggaatcaatggtactctgcaacttggaaataggaagattttagaagactcaaacactgactttcttgtgtgcaaaaaaaaagacgtattgagttaagacaagtctttccttgcaaggatacctctaatgctcatacaccacctcccctaacgttaatatagcttccaggtcagtaaccagtgtcagagagcagcccatgcaactacaaattcaatagatgtcgaacacagggtcaagcctagaataagaagtcttagctaattaagtatgctttgttccccaaatttatattaacaaaaacttggatatgtcagagaatgcattctaagttcactcaacctaggagggagaaacataattttaaattaagagctgaagcattcttgtcctaacaaaaagcaaggaaaatgaaatatcacaccacaggagggatttcacaaattagtgtcaacatcaaaaccttaaaataggcaaggaaaatgcagatttacaatgaactcttgtacttgttttgttcagagaagagatggttctgagagaatgacagtgaactaaccccagctggtttaattgatgctttcaactgctgcttctgatcaactccttcagctagaataaattgatgaggattttggcatgtggtattagagatggttattttttcctcttatttgcattgttcaatgtagtaaatactagctgtatagggctacttcaattcaaattaattacaatgaaatatacttaaatattgcattttttagtcactgttggttcattattgaatatcttcagctaagatttcccatctaaatacactaagaggtggcttagttaactggtcgtccacaaatattgacgctgatgttaactcctgatatattctctgcaaatagaatattcatgagcctcctcctgaaatcagcagcctagagatagttttataaattggatacaagttggaaatctatatactctttcagtttttgaaatattagcttcccagggaagaaaatcaaattcataagctatgttaggacgatttaactcaagatgttcaaaactgaaatgacgtattctacaatatgtgataaaaccaccccctaacaacttaaagcaaaacagggattgaccttaaagacctgccttttcctcatcccccaatcagttttcaaatctcgcattttatttcaaaaggtccttatccccctagtctcttgtttctagactcggcacatatttaagtttgttacctctatctactgacatttttctcttcgaacggtatctatgcctgccaaatgtgaatatacaaaaaacaaatcagaatgtgccattctgatttaaactgcttattagttaaaaccctcaagataacatctgggttcttggctgcaatgagtcaagcctacttacatctttttttgtctttggctgcacatttcctatcacatcacactccagcaaagccaagctgtgccggccttctaccccatctccactattttgccccgcgtcgccgcggctttttgaccctcatcacagcggctcttttgcccttcgccgccgcggctttttgccccaagcaccacctcggcttttcccccgccgccgcggctttttccccaccgcggttttttgcccccacccgccgcctcgggtttatgcccgccacggcttttagttccctgccgccgcggctttttgcccgacccggctttttgccccccaccccccccccgccgccgccgcggctttttgctcgacccggctttttgccccccccaccgccgcggcccccgccatcccttatagctgtgccggccttctaccccatctccactattttgccccgcgtcgccgcggctttttgaccctcatcacagcggctcttttgcccttcgccgccgcggctttttgccccaagcaccacctcggcttttcccccgccgccgcggctttttccccaccgcggctttttgcccgacccggctttttgcccctcgctgccacggctttttgccccccgccgccgcggctttttgcccaccgcggttttttgtctccccgccgcctcgggtttatgcctgccccggctttttgccctccgcaactttttggcgccccgggtgccgcggttatttgcctgccgcggctttttgcacccccgccgccacgactttttgccgcccgccgccgcggctttttgccccgccgccgcgcctttctgcccgccgcggctttttaccccccgccgccgcggctttttgcccacccccgctgccgcggctttttcacccccgccgccgcggctttttgctcccccgctatggcggctttttgcgccccacgcccccccgccccctgccgcggttatttgcccgcggcggctttttgcaccccaggcgccgcggctttttgccccccgcccccgtggctttttgccccatggccatcctcagaagcgtgagtggaacagagtgaagggaaagctgttttcttcgaaagctcaaaaatcttgaactttcaaatagggataagtgttatttttgctccaagcacacatttgagaaatcttccatttagcggatatgatgataaacccacattttttgttttaatctgaaaatgtatttgtatggttcttggaaatattttttttgcatataaaattatagtttatcatcttatttcaagttttatttaccatttgatagttactcctaaaatgtcattgattaaagaatcatctattgctccaactgctctttactaaaggtaatttgtctttttaacctcatcaggctccttttaagctctcaaactgaccttatatttttttacagattgaatgcattaagtccatttattatttatgatgaatttatttatgtatttattttcgctatcacaagtagaaaaagcctataagttgctatgccaaaaacctgcctctagatggcaaacaaaccccgcaatacacaaaagagagccaaattcttagaaaccctgggaaaggaagagggctactgtcccattaacaacttggagcccttaaggcaagaatgaggtggaacatctggggggagacaccagggtgcggagtagtggggaacctgctctgtgctctgagactgaaagcccagccttgcctctcaccactgccttgactgtgtccccatctgctgtgaagtgaatggtgtcttctaaattcatgctgagccctaattgctgaaaagtgtaagacatgcaatggggggattatgtgcatcttcctgacaccaacatgatgctcaggaaggagacttcttgttttctcttaggattcttttactaaccaagattttgcctctactgcatatttccctttgctgattgtccctcccttttgacagaagatggcccagggcattcactactaagtctcaacctcttacccaaagccctcagtctagtgttgctctttccttcatgctatttttgtttcttttcttgtcatcatcttggcaataaaatagtcacttttttctttctacctattaaagatgttaccttagttaattacagtggtttccttcagaatgataaatggtctttcaaaatgatgtaaagagatctaaatccgtgtgctccagaagttgaatgaagctctgtctagcacgggtgccagtgactctcccagagtgctccatgcagctggacccacggagtccctctgtgctgtcatatcacccactgccttctgtgaatgagatattctgattggaatcctggtggatgctatttgagccatgcccccacaactcctatgaaagccgaggaccacaggcccctgaagacaatcacaggtctctagactcacagctcatgaccgtactctgcagacacagcttctccccggatggctgagttttgtcattggctgtgtccttccttgtgcatgacaacaggagacatagaaggtctgtaagcagccctgcaagccaggttctgagcaagccctcctgtgtggggccctcttacctggacataggtgtgtaaaccaaaaatgaaactctaagctccctaaccaactgaatgaactcctcctctcagccaaggacacaccaaaatcaacctgaaatacaatacagtccatgatcggaacggatgattggacatgccttaacttaccctcttccctttaaaattcaggcagaactgaccagcttttaatatgaagacagagaccttgagactgacaaagaaaactctttatagcaataagataccaatgtgacagataccacgtcctaagagaaatcaaagtattttccccaagatattgttatttaatgtatttaaaaatgcctctgcaaagctggtttttgtgggagaaatctaaattctgtagagattcctttttaagtctctttcctgacccagagagatttaactaagagtttggcaccttttaagtctactaagaaacaattacaatctattctctctgaagcctgctacctggaggcttcatctgcatgatgcaaccttggctccaaaaccctttttctaaacccagaaactcccttgtgttgattacaggtcattagataaactctttcaaccacctatgaaatctttgaatccacctatgacctggaagtccccaatatcccccctccttcgggctgtcctgcctttcaatatcaaagcaatgtacagcttacacgtattgattgatatcttatgtctccttaaaacgtgtaaaaccaacctgtagcccgacgacctttgacacacgttctcaagacctcctgaggctgtttcactgatatttctttaactttgaccaaataaatttctaaactgattgagacttttctcagatacttatttgtttataggtatcacaggatacacttaaggaattgaagagatttatgacattgagaaaaggaggaagccagggtgtgtggagagagagagagagagagagagagagagagagagagagagagagattgtgatgtatgtacaggactaacactgagacctggttatgtaatggtgtagtaatgagtatcatccccaaatagtgaggtttcattccaagaagactatgcatgtatctcatttgggaaaacagcttttgcaggtgtaaattaaggagcttgaaacagggagatggtcttagattaatcaactgggacttaaatgcaaactcaagtgtcctaataaaaacaagaggtagagagacatttagcatagactgaagtggagaaggcagtgtgaacacagagacagagattgcagtgatgtgtccacatcccgggagagagaagccaccagaagctggaagagctaaatcagactgctccctagagcttcagaaggagccagaactgatgactccaagatcttagcccagtgaaactgatctggacttctgaactatgagagattccattcctgttgtttgaagctaccacatttttgagaacttgttacagtagcccgaggacactaacacaaatggggctccgggaaaatccagactaaaggtgttgtgttggtttgcaatctccttgcttaactttctgatactagacgtaaatagattggtgaaaaattttgtgaatgaagaaatgtacatgaaacctacagtgtacagagaagcatctgttagttataagataaatattgataattttagttgaaaatgacatatgactgttaatatctcacataacattctgagttactcaagaatgcataaaaggggcactagatactcttctcatgtatgtgtgtgtgtctgtctatacatgtatgtacacttcatggtgcatcagctggcagaaccctcaggacaccccttcacatcctcagtgccccatttcacacatgaggaaactgttcatgacagcacatggctgatttgcataaaagtcacttggtcagcagttgttgaagctgaacttggaatctaggtctatctgaccttaactatgttccttccacagagccacgttcattccatagaggaacccaccacctataaaaccagaaaagagacaaagccagaagtgcagggtggatttcttaacacaagctcactgcgacctctactcctcatcacgctgacactaagcttaaacccagacccttctacagttttgtctacaaagcacaatttgcccaaagcctttacaaacaccaacagcctttctttcagatatggcagcagggtcacatcttacacggccctgaccacattttgtctcctctgccatccccatctctctgactcagtcttcgcttgcagccataaaaaaggatgagttcatgtcctttgtagggacatggatgaagctggaaaccatcattctcagcaaactatcgcaaggacaaagaaaccaatcactgcatgttctcactcacaggtgggaattgaacaatgagaacacatggacacaggaaggggaacatcacacaccagggcctgtcgtggggtggggggagggggggggagggataggattaggaggtacatctaatgtaaatgatgagttaatgggtgcagcacaccaacatggctcatgtatacatatgtaacaaacctgcacgttgtgcacatgtaccctagaacttaaagaacaataataataataataataataataatgggtcttgtacatctaatttgccctacaaatgttaaaacagcaaacccacatccccttcctcttctcatgtgctgtgagggatgacctccaggctctcagataccaagattgtacaagacctaacccagagaattactcaagacactttctacgtaagaagaattgtggtgctagctctcctcatagaaaaatgttttctgtctcttgttgaaattgacagcaaacacaaaaacacagaactatttgggagaacagaggacagtgatacactagggaagtaaaacacaccccttccccttgcattggtttcctgttgctgccgtaacaaattaccacaaccttactgctccccataacacaagtgtattatcttacatttctggaggtcagaagtctcaatgaagtaaaatcaaggagtaatagggctctattcattctaggcttcaagagagagaatccaatatcgagcattccatctttctgatgttcccacattcctagcagcatggccccttcctccatcactccagtttccctgtccgttgtcccaggtcctctctggctgttaccttcctccctccctattataaggacccttgtgattatgatggtctcacccagatcattcaggatactctcctgacccccaaattctcaaccatgtctgccaagttatttttgacatattcataagtaatgatcatagattccagatattaggacaatgatgtctttagtgggtgtattattcattccacaaacaaccctcatcatccacacaatggtcttcccctaaggtagaataaaaatatcacaaggcagatttacgaggcgatcgacctagaaaaaacctgagaatctaggactgtctgatgtgtggatgtcaaatcctgggagattctgagtctctgctctatgtggactctatgttgtgtagccatttgtggaaggcttctgtgattttgtgacctagagaaaatgaatctctgctaaaatcaaatctaagaaagattggcaaagggaatttaaagatttcctaaatttttggaatttccctatgcattaaagcatgagaagtggcaataattcaaaccaacgatgccctccaagaatgaggatttttccaatgcattaggttgggtcccctcagtgagaaggatgccaaagattcgcatgcaggcagtatatttacaaagtgcgggaaacaagcaaatgagcaagggaggggaggagggaaagggaaagtgaaaggtgcctcagaaggagccacctctgaggatgacgacagctcaagcccacatagaaacacaggaaaaatgcctctgttattccacctgagaggtgagggagctgcgggatgtgtacacctcccttgtcatcactgattgacagccgtcctaggggatgctaattccaggccatgaggtctgcctcatttgcagcctgagctgcttccccaggttcagacagagcagtgaaggggagaaagggccatagagagtcagctgaagtataatgactagaatccccaaggcgtagtaacaatgactgctaaaattatgcacaaagaaaaagcgcatttgaatccagagatgtatctctctgaatctggatatatggatcctggcagcctgttcagtagccatttcccagaaatccagttctctggaaaagcagcaggaggtttgtgcacaggctgcactaccttggtctggccactggtagtcgtgcatgagaactactccctggagtatttctcagtccactgacactgatgtaattggctccacttcccctgctgttgagccaggccgacacgccctgggcaaaggcatctgtgtgaagtattgaggttcaaatcagtgcttaagatatgtttggaggcaaaatactttttcatctacatgggcagtgtcttggcagaagatggagattctctctaaatggatgtgagacagggtggctggcatctgggtcaggatgatgccctggtgcatggcaagaacatgcattgggcagcagctgtcctcgctaagcagagaggttcactgacctggcttttcccccctcacctgctctccagaaagccagactctagggcagatgctcctgagaccccaggaacaggctggtggggagcgcagctcagagcattactcaggggatgtggcctttgtcatcctactttgaaacaattgattatttgagcctagattgatagagggcttcaagttgattttaatcctggctcctatagtccgcgagtgaaacagagattttgaaataatgagacctggtattactagtcagctctccatgctggagaaacataagaaattataccaaaggcaggaaaggggatagaatatggggatcatcacgccaagaataaggtgcagcccatttagcccctaggtcttaaagagacccatagctctggataatggcagatctatgcgtgacacattatcatctttgtgcatcttcagagaattgtttttccttttactcctaggaacaatgtcttaagtttgttagtaaattctattgaatttattaaagatgcttctgataaattctttttatattcatttcaaaaaagaagcaatttcacactgacagagacattgttattatagcactaaatacttttacactcatcaaattcctttgagactaactgaaatttctgacagccccacactctataactttattgtaaattttctgccaaaaatgatgctttcctatacactcttaatacaagtataaatatattatttaatctagtcttaggttgatttaaaattttgaaaattcactccaaaaatatgttctgtaaccatatggccaccaatgagaagtgtactctttcaaggtaaatctgtgctgccctggtctgacctgggactctggggatactgcgcccgtgtgctgagttactgagatgagccagccctgcagctgtgctcagcctgccccatcccctgctgatttgcctgttcctagagcacagccccctgccctgaagacttcttataggctggccacacccggtgcaggagtcagccccagtcaggacacagcacggacgtgagggcccccactcagctcctggggctcctggggctcctggggctctggctgccaggtaaggaaggagaacactaggattatactcggtcagtgtgctcagtactgtctggaacttcagggaagtcctctgataacatgattaattgcaagaatatctgtttttatgtttctaacttcaggtgtcagatgtgacatccagatgacccagtctccatcctccctgtctgcatctgtaggaggcagagtcaccatcacttgccgggcgagtcagggcattagcaataatttaaattggtatcagcagaaaccaaggaaaactcctaagctcctgatctatgctgcatccagtctgcaaagtgggattccctctcggttcagtgacagtggatctgggacagattacactctcaccatcagcagcctgcagcctgaagattttgcaacctattactgtcaacagagtgacagtaaccctcccacagtgttacaagtcataacataaaccccaaggaagcagatgtgtgaggctgggctgccccaatgctccttctggtgcctctatctgctgagggaagttctcaaactcagtcaggtttggaaagtcatcgggagattttcctagaggaggccagggaggttcctctgaaccctaagcctctttcgccctcatccccagcagaaaagacgtgacaatgcctgtcctgactgaataaagaagagagataagtccagctgaggagtctgtgttatgggataatcggaatttgtacagcaaaagagaagctattctcagtatttcaaggagaaattattcaagttgaataaattagagtctaaaccacagtctttccgaagcctatggagtgttattcatgaagcaggtactagacacaggggattctcaggtgctacttcagaagccaggatgcacctgcccctggtggtatgtgctgaacaccgtgtgatgatcctcagtcctgtctgggaagcccagggctgggggtgctgatgctctcagctgcctgcagcacatctccaggtgattctccagtccacacctaactgcatgtgttttacttcaggtgtcagtgtacatgaatccaccactctgacttcccaatctcatgacagtaattagttgtaacttattgtaacctcatggagcaactctaaagaaaccatagagagaaaaggagttttggaaaatgtgctcccggaagtgatagtaatgatggggaattgacagctgacggggaagtaaggtgactctttccacaaggctcaacattttgccagttatgaattgttgcaaaatacatttgaatgtgctttcaagtattaccagtttggggtcatagctgaaaaactttattaagtcacagataaaatgggaaaatcaggaatattttatattgtatgaaatatacaataacactgtgtgtgatggctcaggtctgtaatcctgtgatagttaatactgattgtcaacttgattacattgaaggatgtaagcattgctcctgggtgtgtctgtgagggtgttgccaaaggagattaatatttgagtcagtagtctggggaaggcagaccccctacttaatctatgggcaccatttaatcagctgccagtgaatataaagcaggcagaaaaaagtgaaaaattgagtctggcccagcctcccagcctacatctctctcccgtgctggatgcttcctacccttgaacatcggactccaagttctttagttttgaggctcgagctagctctccttactcctcactcctcatgcctgcagacagcctactgtgggaccttgtgatcctgtaagttaatatgtaataaacccatatatatatatatatattgaacttattagttctgtccctctagagaaccctcattaatacagattttggtaccaggaatggttctgcaggatcagaatattaaggctggagttcttttgttggttttggggtttctggatttggctgctaaatatgattagatcccaaaatgctaaggactctacttttaatagtgtagagaatattgacagttcttggcatgaaaggtttaaagagctatgcaaaacaaattcatttgacactaatgaatcatcgctcatgagaggcaaggagtttagtgactctgtacctaatacccttgacaaacaccttgcaaaatagatttgtgaggacagcacctgcatctttgaagagccctgtaaaggctcttctctgtatgtcagatctaatggtgagaactgcagtcactcagttacaaaagttaaatacaatttggaataattggatcctgaagtggcaggggccaagtggtagcactcaaccctcaaaggcacggtgggcgtagctaccgtaatgggcagaaaagacaaagcagcaatctgaacagtctgactcacgtagagctctggcattggctaactaatcacagtgttcctggaagtgaaactgacaggaagactaatgcattcctacttaatttatgtaaggaggaaacttaaggtcaaacagataaaagactaactggaatcataaaaacagagattcatggcccctcaatcaatttccagccttgagccagtttacagacccagaaccccttgaatgaaggggaggctgggtccccctgaggtgtccatggcagataggaatgctgctttgaggctttggcaagcctccataggtgaatcatggtggaggcctctagtattttgcagcaaggaccggtcatcttctccagttaactactctccttttgagagacagctcttgtcctatactgggcttttgtggaaactgaacatttgactatgagtcaacaagtcaccatgcgacctgaactgcctatcgtgaactgggtgctttctgactcatgtagccataaagtgggtcatgcacagcagcattccatcatcaaatggaaatggtgtataagtgattgggctcaagcaggtcctggggggcacaagtaagttacatgaggaagtggctcaaatgcccacggtctctactcttgccaccctgccttctctcccatggcctgcactgatgacctcatggggacttgcctttgagcagttgacacaggaagggaggactagggcctggttcacagatggttctccacaataggcaggtactgcccaaaagtggacagctgaagcactacagcccctttctaggacatccctgaaggacagtggtgaaggacaatcttcccagtgggcagaacattgagcagtgcacctgattgtgcactttgcatggaaggagaaatttccagatgtgcggttatatactgattcatgggctgtagccaatggtttggctggatggtcagggacttggaagaagcatgattggaaaattggtgacaaagaaacttggagaaagagtatgtagatggacctctctgagtggtcaaaaactgaagatatttgtaccctgtgtgagtgttgaccaacaagtgacttcagcagaggaggattttgataatcaagtggataagatgacccgttctgtggataccactcagcctctttcctcagacacccctgtcattgtccaataagcccatgaacatagtggccatggtggcagggatggaggttatgcatggattcagcaatgtggacttccactcaccaaggctgaactgtctgtggccactgctgagtgcccaatttgccagcagcagcagcagagactaacagtgaaccctttgtatggcatcatttcctggggtgatcgaccagctacccggtagcaggttgatcatattggaactcttccaccatggaaaggagagaggtttgtcctcattggaacaggcacttactcaggatatgggtttgcctacctgcatgcaatgcttctgccaagactaccatttatggactcaaggaatgccttatccactatcacggtattccacacagcattacctttgaccaagcactcactttacaggtaaagaagtgaggcagtgggctcatgctcacggaattcactggtcttaccatattccccatcttcctgaagcagctggattgatagaatggtgggacggccttttgaggtcgcgattacaacatcaactaggttgcaatactttgccgggccggggcaccatactccagaagaccatgtgtgctctgaatcagcgcccaatgtatggtattgtttctcccatagccaggattcacagatccaggattcaaggggtggatgtgaaagtggaaccactcactatgatgcactagcaaaatgtttgctttctgttcccacgacattaggttctgctttactagtcatcttaactccagagggaagaacgctgctaccaggagacacaataacaattccattaaactggaagttaagatggccacttggatgctttggggtcctcctacctttaagtcaacaagctaagaatggagttacagtgttggtggcagtgattgacccagactatcaagatgaagtcagtccgctactccacaatggaagtgaggaagagtatgcatggaatataggagatccattagggcgtctcttggtattatcatgcactctgattaaggtaaatgggaaactatacccaatccaggtaggactacaaacggtccagatcctctccgggtcacgaccttctgaggtgcttgctgaaggcaaagggaatacagaatgaatagtggaagaaagtagttatcaataccagctacaaacacctgaccagctgcagaaatgaggactggaactatcatgagtatttccttcttttgttagaaacatgtttgtgcatgtatgcacttgtactaagaaaatatcttcatttcatttcccttttctttatcaggtgacatagatttgctgacctcatatcagcatttaagtattgtttactttatgtaagagtatttgggttggggatgggtgcatttccagttgtaggaaggatagtttattatgttaggggtaattatgaccttactattgtctgtattttaagattatgtatgatctcaggagatgtgtgtgggttcaagttcacaaggggtgggcttgtgatggttaataacgagtgtcaacttgattggattgaaggatgtaaagtattcatcctgggtgtgtctgtgagggtgttgccaaaaaaaattaacatgtgagtcagtgggctgggaaaggcagacccacccttaatctttgtgggcacaatccaatcagctgccaacccagccatactataagcaggcagaaaaatgtgaaaagagacgggcctcacctcccagcctacatctttctcccatgctggatgcttcttgccctcgaacatggactccaagttcttcagttttggaactctggctggctctttttgctcctcatccagcagatggcctattgtgagacttggtgattgtgtgagttaatacttaataaacttcctgtattagccagtgacatctagagggacagaactaacaggatatatacatatatatatacatacgcacacacatacatatatatgcacacacacacacacatatatatatttatttataaaggggagtttattaacttacaggatcataagttacacaatgggctgtctgcaaactgatgagaaaggagagccatggggtccaatgtttgagggcaggaagaaaccagcatgggagaaagatgtaggctgggaagctaggccagtctctccttttcaaatttttctgcctgctttatatttgctggcagcagattagattgtgcccaccagattaagggtgggtctgccttccccagcccactgactcaaatgttaatctcttttggcaacactctcacagacacaccctggatcaatacttcatatccctcaatcctatcaagttgacactcattattaaccatctcactccccttcatatatatatgtatatagtcctttaattctgtcagtctagagaaccctgactaatacatctacacttctgatgatctatttcttttattttaggtcatttatttcccctgggttgcctacactcgcttcttcccactcccctatgaaggacaatataagcctctggacctcactaggtcagggcatgtccctgcttgcactatccatgacacttttctcttttactctttagcaatgagggaatgtcatccttacccagatgccagccacctgtctcacatccaggacagagagtctccatctcctctccagcaaatacctatgtatgtgggcatggtggcatgcccctgtgatcccagctactccataggcttagaggggagaatcacttgtgcttgagaattcaaggttgcaaggagccatgatcacaccactgcacttcatgctgggcaactgagtgagaccctgtgatttttcccctacattttacagaatttttttttgcctctttcttctattaatttatgttttgtccattcattttctgcaaaccttcagagggcaaataggaagtttccctttttaacgtggtggctcacgcctgtaatcccagcactttgggaggccgaggtgagcagatcacctgaggttgggagttcgagactagcctgaccaacatagagaaaccccgcctccactaaaaaaaatacaaaattagcagggtgtggtggtgtgcacctgtgatcccagctactcaggaggctgaggcaagagaattgcttggacctgggaggcgaaggttgcagtgagcccagattgtgccactacactccagcctgggtgacaagagcgaaactccatctcaaaaaaaaaaaagaaacaaaaacaaacaaagaaaaaaacacctactgcctcactgaattaaaggtgtgttcagcagtttctttgttatttcgaagagtgtcatctgcttcagcagggtcagtttttaatgtatttgttttgtttcttttttctctgtctggtgttgttttctattttattataattttttaaatttgagggatgaggttttcatagcactgaatatcaaacaatgaatccgcatgaatgattcacctaatttccttggttttagtcctctatacaggttttatatagcaaaagaaccatttaaagacttgggttacaaatgtattttattttacctctggcatgccttgggctgagaaagcattatatggtgacacagtatttgtaacattctcatagccatctggcggtggttcaaggtatgacattttgaaaatctagcaagaattaaaatatgtcaagttagagataaaaattccagattattattaagatataattcattttgccccaagtatatacttcagattaagcatcctggaactaggttctataattaaatagataaattacactgacaacaatgagaaagagccttatcattattattgtcttcctaataatagaaacttttataaatgcatgcaatcccaggtaaccaaaagtttccttataaagtgtaacagcagagcttcaaaggtggcatttggcaagcctctttttttgactatgccttttcagcttcctttgtgggctccttttctttcatctttatttaaataatatttccctatgttttatccccagcccattgcttgcctctgtactgcctccctgtgagacttcattaagtatcagaattttaccaatagctcatatgcttatgatgcttaccttttcagattcgtatatttaaatgttttgtgattatttcatcctggatgtccaaactcaacatgttaaaattcaaatttatcatctctcaccccgggcctgcttttggtctgcatttcctacctctattaatagcttcagttattagccaccgacaccagacagtctcggagtcatcctgaactctatcttcccctccttccccaagtcaatcactaatcaagtcctgctaatacatttccttactatttctgaaatccatccctcttcctcattcctactaacatcctaatttaaaactttattatcttttacctggactattgtcttaagacaacaactttaacccgttgcttagcctaggtgtaatccacagaggatcttgtctgtctaagatgcccctctagccacatccttcccctgctcagatcttgtcattggctcccatgaactgaagttgaagtttaagctccttaggacagcatacacgcccttctatgatctgttcccagaacatatttactggtttatctcatatcatggcccactttgtattttacacttttgaaatacagaaaatcattacattctcccaataatactaagctagtatatgcctaaaagcctttgtcaatattttgtcttttgttgagaattctcttagcttattttgtcacgtggttaactccttatgtcctttcacgactcacatgtcaagaattcaggaaaccttctctaactcccaggctgggctgagtgacccttttctgggtaaataatgaactctaatcatactcttcatagcacttaccatactaatttgaagtctgaagtattccattttctgcctcagtttacttaggcaaaggaaccatgtcctagtctcattctggcctcaggacttcagcctgggcgacagtgggagactgtgtgtcaaaaaaaaaaaaaaattgccaatgattgaagcctaatactgaagattctggtttattaataattagtctgttgctgggtgttaattgagctccccaagtgattactcatgtaggacttcaaaacgataatttagaaccttgtgactaaaaatctgggcaaaaataagcagcatcagtatcacctgggagcagcttcaggtctcactttagatttactctgaatctaaatattatatttttattaaaaaaattaagaacagatgacaagcttcaactacatctaaattctttagatttactttcaaagaatcaacattttgacacaataccaaagtgaactaaattcgcttttttttttttttttttgagacagagtcttgctctgttgcccaggctggagcgcagtggtgcaatctcggctcactgcaacttccacctctccagttcaagcgattatcttgcctcggcctccaaagtagctgggattacaggcacatgccatcatgcccggctaatttttgtatttttagtagagacagggtttcacaatgttgggtcagctggtctcgaactcctgacctcaagtgatctgtctgcctcagccttccaaaggctgagattatagacatgggccaccatgcccagcctaaatttgctttaatttggagaagtactggtctagaaaacacaaattccaaggagactcaggttcttaagttgatttcttgagtacaagttcttcaaatgcattctccaagattaatttttttttttactttttaaattgacaaagattatacatattcatggctatatggggatgtttcagtacatgtagatggtgatcagatcagggtaattagcatatctatcatctcaaacatttattatttctttgtgttgggaacattcaaactactcctaggtattttaaactacataatatagtattgttaactatagtcatctacagtactatagaacactagaacttattactcctacctagctgtaattttgtatccattaacaaatctcttaccattcctcctttctccctacccttttcagcctgcagtatcctctgttctactttttacttctatgagatcaacttttctttagcttctgcgtgagtgagaacatgtggtgttgaaatttctattcctggcttattttgcttaacataatatcctccagttccatccatgttgctgagaatgacagggttttatttattcttttttatggctaaatagcattccttggtgtatatataccgtattttaaaaatccattcatctgttgttggaaatctaggttgattccatatcttggctattgtgaacactgttgcaataaacatggggatgcagatgtctctgtaatataatgcttttctttcctttggataaattcccagtagtgggattgcttgaggtgtttcaatactgttctccatactggctgctctaatttacattcctaccaacagtgcataagagttcctttttctccagctactcaggaggctgagggaggagaactatttgaaccctagaagcagagggagccagattacaccaccactgcactccagcctggacggagagtgagattctgtcaaaaaaaaaagtcccttttcttcacgtctttgtcagcatttgttatttttgtctcttctataatagccatcctaactgaagtaagatgatgcctcactgtggctttgattagcatttccttgctgattagtggtgttgaacattttttcatatatttgttggtcatttgtatgtcttcttttgagaaatgtctgttcagagcatttgtttatatttaattagattgttgtgcttctttgctgttgatatgtttgaattccttgtatattcttgatattaatttcctgccagatgagtttatactttctcccattctgtaagttgtcttttcactcactttcttatttcctttgctgtgcagaagatttttagcttgatgtgatcctatttgtttattttttcttttgttgcctgtgcttttgatgccttattcataaaatattttcccagagcaatgtcctgaaggatctcccctatgttttcttctagtagctttaccattttgggtcttatatttgggtatttgagatactttgagttgatctttgtatagggtgagaggcagaggtctagtttcattcttctgcatatggatatccagtttttccagcaccatttattgaagagactatcctttccccaatgagtgttcttggcatctttgtaaaaaatccgttggctgagatatgtggattttctgggttctttattctattccataggtctatgtgtctgtttttatgccaataccatgatgttttggttactacagttttgtagtgtattctgaggtctggtagcatgatacatccagctttgttctttttgcttaggatggctttggctattcaggatactttttgattccataaaatctctttggatttttttttaattttgtgaagaatgttcataggtattttgatagagattgcattgaatctgtaggttgcttttgagtagtactgtcactttaacaacattcatatttctgatccatgagtatgaatgtcttttcatttgtttgtatcctcttcaatttctttcattagtgttttgtagttttcattttacctccttagttacatttatgtctgggttttttttttttggtaactattgtaaatgggtttgccttcttaatttctttttcagcaagtttgttgttcatatataaaaatgcaaccaatcttcatgtattagttttgtgtcttgcaacttcactgaatttgtttgttctaaaagttttctggtagtcttcaggttttcctatatataagatcatgtcatctgcaaataggaacaatttgatgtcctcctttccgatttgaatgccctttatttctttctcttgtctaattactcttgataggacttcacatttatatactttgaatatttaaaatgtttacataaatgtcagaatcaactttcatttttcatagaaaaagaagatcctacttgttttgtagttttaatattaatcaattattattatctgagacaaattattaacaaaccatctattaaaatatttcaccacaaataaattccataaggaaaatatctacaactgtttttatgaaagaaaaaaaggcttctctacagttgcttaggcctggtgccatggcacacacctataaatcccagcgctgtgggaggccatggcaagaggatcctttgagcccaggagtttgagaccagcatggacaacaaagtgagacctcatctctacaaaaaataaaaaagaaattagctggccatggtggtgcgtgcctgtggtcctagctactcgagaggctgaggaaggaggatcacttgagccagggaggtggaggtttcactgaaccatattcacaccactccactccagcctgggcaacagagctagaccttgtctcaaaaaattaagttagttaaattaaacataaagttgcattgtatttaagaaattgggaaagcagaaaatgcttctgtttttcttttgagttgaacaatgagaacacatggacacagggaggggaacatcacataccggggcttgtcaggggggtgggaggctaggggagtgatagcattaggagaaatacctaatgtagatgatgggttgacgggtgcagtaaaccaccatggcatgtgtatacctatgtaacaaacctccacgttctgtacatgtatctcagaacttaaaatgtaataataacaataataaaaacctcaaaaaaaggaaatgcttcttcttagaacagattacataccctcattgctttttataatagcctgtaataacagaatatccacaaggtggcagtaatatatcagtttcatcctctgaaattaaaacttttgcctattcagtaatacaatggatcttttgaactcactctaacacgtagaatacagcaatttgacttaataattagcctttaaatttatagtcttgtattatcactttagtagtttgaattattttgtattttaatatatttaaatgaattagtcctatagaaattgactaatttgacatgtgaaggtgtttttattctattttcagaagtttagctttaaaaaaatttctaaacttcgatatctggtgagtgtcaatgtttttatcttattaaaagctgacagaccacactatattcaactgatttttttttaacaaggatgcaaaatcagtttaaaggaaggatatctttttcaacaaatggtgctacagcaattggacattcacaggtacaaaaactaagactgacctaaatttatactttatataaaatttagctcacataaatcacaggcttaaatgtaaaatgtaatattataaaacttaaagttgtgtatggtagctcgtgcctgtaatcccagctactactcaagtggctgaggtggaagcatcacttcaatccagcagttagtggctgcagtgagcaatgatggcaccactgcactacagcttgggcgaaacctcgtctcaaaaataattaataaataaataaattcactaaactttttaaaatagaagaaaactcttgagaccttgggctaggcaaagaatttttaggcttgatattaaaaacaaaatctacaaaaggaaaaagtgataaaactggacttcattagaataaataaacactttttttttttttttttttttttttttttacttagaaagaccctgtaaagaggttgaaaaaatgaattacagactgggagaaataatttgcataccatatatctgacaaagaacttacatctagcatatgtaaaaaattctcaaaactcaatggtaataagataccaattagaaaataggcatatgtgacctctctgtattataacttaaacctcatgtgactacaattatttcaaatgaaataaacaaaacagtaatgcctgtttctggcatataaaataatcagagaacatagaattgtacgaagttaaattattgggccatttacttaatttaaatatttttaaatgcgtgtacccattttgcttgaaggtgtgtgcaagtatgcttgtattttttttaacgataatatggtcacatgagcattaaatttattttttaaaagtttatagttaccccacacaagttcttattgattccctcattcttaacacctgcatagtatttcattttataattaatggattgtaggtttattcttttaaaatcacttgtgttgttctcatttttttttttcactaaaaagtgttgcaatgcacaaaactaaaaatataaggagggtcttttctggatctctgttgaaaaactttgaataaaaattacaagttcaaatcacatgcaaaataaacattttaattaatcgggcttttatgcaagatgttagtagcagtagcagcacagttttattaagatccctgaatctctcacaaaaactgactgagcaactgggataacaaggtattaactacgacaaaacaatgtaacagggtgtcatcatggacgttttgtgaggttaaaccacagggacccaggggaatcaccaatttttttggaagaaggaaaggaaaggaaaaaaatgtttaatggccctgggaactggaaaacctagaaatacaagtgctaacatctgtgttcctaaattcagagattcttactaggcaaaaagaactcagcagattaatctgagaacagcagctgaggctggcagaaggcttcctgggcctcaactcatagctgagagtgagggtggcaaaaagcagtgctgtgagtggtctgtttcctatgaaccctacaaattaaccacccccaaaacaaagccctgtcctaaggagaaactgcaggaagtcaattataaattgagttgggaagcacactgaggctcaagaaaagggaagctccaggttaagatgcaagagaagaagggaaaaggcagttttctgcaagttcaagcacaaataatttctttaccttctagttctggaaataccaggtgctgtgtatgtaaagcaggaattttggttgaatattatataattttctgacccactgttactaatccagtttcccctgtactcagatcttccatactacagacagacctgacagatgctcagcaaatagtagctaatattttctaggaaactatgtgctaaacgagttttcttaaatttctacctccaggtctgtaagttgatttgaagcattaccagtttctggttctgcacaggttgttgagcgcaggacttctctcctccagtggaaagtccacctgctcacaatcaaccatcctttcctgcagccttggagacactactcagtgtagcatgcctcccagtctagaataggcacactcatcatcagtctctctcattttctgtcttatctccattccatctacatacagtttttgttttcaccaatgtttttaaataaacaattgtacaagcacgacgacaacagaaaccttccttcccccagtgttgtagtgagcaaggaatatatttaacttcaaataaaagacaagaacaaatgctggataaagctgacagaaagaaatgcaactgtaggtgctctggcaatatagaaatgatacaactaagaaaaatggaagaaaaggaaagagaaagtattcctcagaatgattttactgactgctcatctgtaatgcctgggagtcaaaggatattgtttatagaaatgtaagcatacttaatggcaccaggggaaacaaagttaatatgattaaatcaaattgtgggatgaaaaatcacatagggaggacaagaaagagaatacagctaataccattgttcttagtttagagacattagctactgtctaaagaaagagatgattttatgaaattacataaggtagccatcagaataaaagtttaactcttccaaatatcacaacatcaaaacaaaagcaataaaacaagacagcaaaagacagatatgtgcatataaatcatagcataatatactgtaatcaaaatataaccaaacacaatttatcattaaaagtaagtgggcttgactcttattagaggaaaaaatattgtcagattaaatcaaaaagcaaatctcaattctatgctggatataagataaagtgttacagaaagtttagaaataaaagtataggcaatgaataaaaggatcttctcttcatgcgttaggagtataaaacagtaagtaaacacatcatatgttttctgtttttacacttaaatggctggagatgttacaccactagtatgaatttacttcagatatataaaggatacacttttatgtggttagaaacagcaatgataatagttaaggtgaaaataacatctgcattgaggctaggaagaaagagccattgttgggtacatagtgatcgtattaccatggagcaatctgttcccaactgaaatgtccttgaccttctactgaaatcatgtaagattctgcaaaagtagtgtttacttcccacaaatcagccatttgtgggaatggctgctattgttgtccacacggaatgagcatcagacctatatttagctgttgtttcattaagagtcgtatttggccctttccagaggccgttatttcaattacattttggagaattagtctatttccagacaaataatttttccagaactttgatccatatgaaatgtccctttggtagggatccagggattgagtttatttttaattactgtagcatcctggtcaggttgagaaacagattacctttatatttccctggcatgtaagcagggctagatttagcgtgagaatgcttgaaagtttatagttttttagaaattttatttactgtgtgtctctttatcaaaataaaattaatgctgaaaagctatattaaatgaattattttgagatggtctcttcccccttcttccagtgagaggatatccacagatatgtcaggagcttgctttacctagaaatgtgttgagggccacaggtttgggttcacctaggaatgtttagggacacctccccaagttgttgttgaagagtggggtaaatgtaagatagaattaggctcacggaggccagatgagagcatcatatcaccccagaaacatagcatatacctaggagatctgttctcagtatcaaagtcttaagcactgtaagattgcctatagaccaagacaacaactatatatatatatagttaataaaatcagttaatatataaacatatatttattaacttatttttatttttatcttcagacagcatcttgctctgtcacctaggctggagtgcagtagtgcaattaaggctcactgcagccttgacctctggggctgaagctatcctcctgcctcagtctcctaaagtgctaggatgagaggtgtgagtcaccttgccaggcccagggcaataactatgcaatgtttatataatttggagcaaaaaatatttgaaatatgtgtgcattgctttttaaccttttctactgatttactttattaaatactgaatagaaacaatatatttataaaatatttattttatatatataataagcacataatgaacacctgtgtctccagtcttggtttaagaaattaagccaaaagtaatcataagtgcttatgattacttttgaagtcacctgtacaacttttgctgactacatccccttcttcaacactctaacgatggccactgtgagcactgtgtatattgaattgtgttgtattttaataccgtgtgcactactttgttttcctagctgtatgctattgcatttagtgagcataatgaattatatcagtataattcacttttgtcatttcattgtttcagctcttctgtactaattattgccaatatatttctactggcataaaaacagacacataggacagtggaacagaatagagatcgcagacaaatctacacatttacaaacaattcatctctgacaaaggcatcaagaacatacactgggaaaacaacagtcttttcaataaatgatcctgggaaaactgaataaccatatgcagaaggataaaattaatcccatctcaccatacacaaaaatcaaatcaaataaaaatggattaaagacttgaatctgagacctgaaactatgaagctagtaaaaaaaaaaaaaaataggaaaggccgggcgcggtggctcttgtctgtaatctgagcactttgggtggccaaggcgggcggatcacaaggtcaggagatcgagaccaccctggctaacacggtgaatctccgtctctactaaaaatacaaaaaacaaaaaaaaaattagcggggcatgatggtgggcgcctgtagtcccagctactcgggaggctgaggcaggagaatggcgtgaaaaaaaaaaaaagaaagaaagcaagcataggagaaatgctccaggacattagtctgggcaaagatttttttgcgtaagacctcggaagcacaggcagcaaaagcaaaaatagacaatgggattatatcaaactaaaaagcctcaagcaaaggaaacaatcaacaaagtgaagagccaagcacagaatgggacaaaatattttcaaactatctatctgacaaaggattaacaagtagaatatataaggagctcaaacaactcaataataaacaaacaaaaaatctgattgaaaaatgggctactgaagaggctgaggtaggaggatttctttttttttttttttttttttttttttttttttttaatgagatggagtctcgctgtcgcccaggttggagtgcagtggcgtgatctcggctcactgcaggctctgctcccccggggttcacgccattctcctgcctcagcctcctgagtagctgggactacaggcgcccggcaccaatcccggctgattttttgtatttttagtagagatggggtttcaccatgttagccaggatggtctcgatctcctgacctcgtgatccgcccacctctgcctcccaaattgctgggaatacaggcgtgagccaccgcgcccggtcaggaggatttcttaatcccaggagtttgaggttacagtgagctatgattatgctactgccctttagcttgggtgacaaagcaagaccttacttctcaaaaaaaatagttaaaaatatataaataaatacaatttaaaaatgggctaaagatctgaacagatattttctcaaaagaagacaaacaaatggccaataggaagacaaaaaatattcagtatcactaatcgtcaaagaaatgcaaatcaaaatcacaatgcaatatcatctcaccttggttgaaatgacttgtttcaaaaagacaggcaataacagatgctggcaaggatgtggagaaagggaaatactagtacactgttggtgggaatccacattaataaagccactatggagaatagtatggaggttcctcaaaaaagtaaaaatagaactaccatgtggtccagcaatttctttactggatgtatatccaaaataaaggaaattaatgtatcaaagacatatctacatgccgatgtgtactgcagcactattcacaatagacaaaatatggaatcaacgtaagtgctcatcaacaaatgaatagattttaaaagtcatatatatacataatgcaatactactcagaaacaaagaagaatgaaattctgtcattcacagcaacataggtggcactggccatttggtttaacgtaatgaacataggccattatgttaagtggaatgagccaagcacagaaaggcaaataccacatgttgtcactcatatgtgggcagtaaaaaagtggatctcatgaagatagaaagtaaattggtggttgctagaggccagcaaggggagtgggaagaggagattaagagaagaaaatataaatgtatttatcaccactaaactgtcctctaaaaatgtacagatggtaaattatatatatatatattttaactcaataaaaagttaaaaaaattctgctgtgtgtttatagggcacatgtacaagactttctctagggttgtatcagttttctattcctgctgtaacaatttaccacaaattcagtggcttaaaagaacacatttttgtaagatttgagtcagttttaaaaaacacacacagacttattgtcttagaattgttttggttggaaatctggcatggctctcactgaactaacatcaagatgttggcaggctgcatttctttctgaaggctctaaaagagcatctgggttgttggcagaattcagttccttgtggttgtagatcctcagtttcttcctggttgtaaactttgggtcattcccagcttctaaaggtcactggcttttcttggcttgtggccccctaccactgttttaaaagccagtaatagcaggccacatctttctcatactgccatctgtctgaatctcagcatccagaaaatattctctgctctcaaggaattatgagattagactggctcaccaaggtaattcaaggtaatttccccatttcaatgcccttaatggtaatcacatctgccaagtctctttgaacatgctaacttacgttagcatgttcaccttatctgaagactgggatgtggctgtctttggtggggggcaattattctgcctaacccaaagatacacaacttgcagatatacaactagttcatggagatgaaacattttcaaatctacaagaaaatgttttctaaaatgagcattgcatattagactttcacgagcactgtatcagacttatatttacttcataatattgccaatactgatatcagatatttaattttctagccagttcaggataatgtgaattgtgaataatatatttgttcatccagtcaacaaacattttttatcagataccaccgatatgctggacagtgtcatggatcctaaaaatatagctgttattattatttttttaaacaaaatccccactgtgataaagcttttattctttgggacaggcagacagtaatccagataaataaatgcaagggaaaattgggggaaaaattggaatggagagctcagaatctggccccagagaagggcagagggaaaggggacccagttcagaatctcggtgcgtccacaccaaacaattccatgagggctgaagagacagagctgaaaggcttgtctgacatcacaaaagacagaaaagtgagccccattttcatctctatcctgacaatgttcctggcttgatttcctccttccagcagacacaagaatcagggagcgcaccctgatggtaacatttttttcaggggcctattttggggatcctggtgagaacctgagtccgtcactgtccacggcagcccagcatggtccccagtgcgtggtccaaggccaagattctctacctccatcctggaggcagaagaaatgtctgggggaaaatgagaggttttaggtggttggcactgggtgagaccaaggagaaattttaaagctgtgtgtcctggggccgggggtggtggctcacgcctgtaatcccagcactttgagaggccgaggcgggcagatcacgaggtcaggacattgagaccatcctggctaacggtgaaaccccgtctctactaaaaatacaaaaaattagccgggcttggtagcgggcgcctgtagtcccagctattcgggagactgaggcaggagaatggcgtgaaccgggaggcgcagcttgcagtgaactaagatcgcgccactgcactccagcctgggtgacagaaagagactccttctcaaaaaaataaaaataaaataaaaataaaaaatagaaaaagctgtgtgtcctttgtttcttcatattttgcagatttttgatgtcaaaatattttcatagtcaaaagagtgttaataaagaatgacttctctgttataaaaaccctaatagtgaatgtatttaccaagaaattagattctatctttggttttttgttttttgccccgtagtttttaaaaaaatagttttattgtgtggatattctacagttagtgtatctattcacctcttgatggacatttggtttgcttccagttgtttttgctatttcaaataaagttgctacgaatgtttgtccaatcgtttggacatacactttcatttgtcttgggcaaataagcaggatttgaatgactaggtggtgtgatatgtttaacttttttttttttttttttttttttttgagacggagtctcgctctgtcgcccaggctggagtgcagtggtgcatcgcggctcactgcaagctccacctcccgggttcacgccattctcctgcctcagcttctggagtagctgggattacaggtgctcgccaccacgcccggctaattttttgtatgtttagtagatatggggtttcgccgtgttagctaggatggtctcgatttcctgacctcgtgatccgcccgccttggcctcccaaagtgctgggattacaggcgtgagccaccgctcccagccagtttaacttttaaagaaactgacaaagtggctgtatttccagcagcagtatatgagcattcctgttcctttgtgttctcaccaatgtttagtatggtcagtcttttaaattttagctattctaataggcaagtaacagtatctcattgtggttttaatttacatttccctaatgatgaatgatgtgcttatgtatcgtccatctgtattctatggtgaaatgtctgttcagatctctacatttgtgttagactatttgttttcctattattgagtcctgagagttctttgcatattttggataacaaatgtatcttcaccagatatagcttttgtaaatttttactcccagtctgtgatttgtctttttattctctcgatagtgtttttcttttttcttttttttttttttttgacagagtctggctctgtcacccaggctggatttcggtggcacgatctcggctcactgcaagctccgcctcccgggttcacgccattctcctgcctcagcctctacgagtggctgggactacaggcgcccgccactacgccccgctaattttttgtatttttggtagagaggggtttcatcgtggtctagatcgcctgacctcgtgatccacccacctcggcctcccaaagtgctgggattacaagcgttagccaccgcacctggcctctggacagtgtttttcacaggtcagattaatttttatataaatcatttattttatttttattatgtaaaattttataatttttaattttatttttaatttcctttttaaaagttaaataaaattttaagtgtaatgatgcaaaattttgtttaaaagtaaatgcatataaaaatgttgatatagactaaaaaattgaataagtaagaaggtagttagttgtcacagtaggagtgaagtgaaaagcttcccctttcaccctctgaagattaccggaaatgaactgaccatacacagattaataaaagaaagggtatacaaacttacataacctgcaaaaacatgagagctatacacaaagtataagacttgaagacggctcagatcttaaacgctctcctcataggcaatagatatatagacccaggatgcagacattattttgtaaataatttcctttggaagctggatgggacagacaaattacaggaaggtgagagatggaactgcacaggaaaaaagtttgtctttgtcactttaatcttatcattactagagaatatttatgaatattttagaataatatatttttaagcccaaatctcaccaaatgttttttctaaaacaaatactttttgttgttgtttgtttttgttactgtgtctcactctgtcacccaggtatggagtgcagtggtgcaaccatggctcactgcagccttcacctcctgggctcaagtgattctcctacctcagccttccaagtagctgggctacaggcatgcaccctcatgccctggtaattaaagaaaaaaaaatttcgttagagaccaagtctcattatgtcaccctggctagtcttgaactcctggaatcaactgatcctcatgccttggcttcccaaattattgggattataggtgtgagccacagtgactgaccacatatttctatacttcactgaggaaaggaaggtgctaggaaaattggttaagaactattttttaaaaagctattagtagtgttttattttattttttaatgattgatttttgagattgggatctcactatgttgcccaggctggtttcacattcccaagtttaagcaatacccctgcctcagtctcccaagtagctgggatgacaggtgtgtgtcaccatacccagctccattagtagcgtttttaacaattgtgggccactgagtaagaataattttttttaaattaaaggttattttttaaaaagcacatttgtagaaaattactagcataatctgcctaaaataaatatacatattgaaaaaatctttgctccgaacaaaaagaaatatattcaccacacatacatacatatacacacacacacatgcacacacgcacgcgcgcgcacacacacacacacacacacacacacacacattatggaagatttcaagaccaggcaataatttccactcaatccaaaaacaatgcaatcccagagctgaatatttaggtgaaaatatatcaggaatgggaggcattcaggtttaattttcatgttttggtagagttaggatgtgagttttcatttaaaaatattctttattttttttgctactattgtggtttctgtattgttactatacaatctgtaaactaaatagtaaaggagagaaaagtgattttcaaagaagctggcttgggaacaggtactattctgggaagatgaaaggtttcacttaatgactggtacctgtgccactctggttattttaactgttaaccttttagcaagaggtttttcttttaaaagacatcctttaatatttgggaagctagtgcaatagtacacattgaggcccacataccacatgccaaatatttaaaaggcacatttctagctaaccactgtacatacatatattttttcttattttctgattttagtttttttccttgtcaacaatttatgtccacacatatcttctatcatcccactttgacaagtaatattataccttcaaaatgatgtggaagactagattggaatttagaaccgtagaaccttgtaattgtacaggcaagtttcttcctgggaaaaaataaaacaggaagaaaaggctgggcagcctctggttcaggaaggaaattcaggagtcccttatagcagcatctctagtacttgggaaccgaacagacttctcggcctgtgaggctggaatgggcccttctggagaacacgacagagaagttatctactgcctttgcccccagggcccaggcaacacttttaccctccattgtttccgaagttaaggggaggagacaatgttttgtttagtgacctcgacagaaaaagtgtcctcctgcaaccactcatttgttactttccttcttcctgaattgcctggacccactcctcctccatttgactggctctgtgcactgatcttatagtcaggagatttttgggaattgtggcttctaaaaatgtacacccgactctacccatagctggccctgtgaacctacacacctgctccactgtgtatccttctcaaagagacactcttcctgctgagtctctgccctctgctcctagatccaaatggcatctcctaccctatccctgtatggtttaacctagggaaactctttcccagaggagtcaggtaaggagacagtggctgagcttcttacagacttaaaggagacatcctggaatttaggagtcagtccttcctttctgtaatccctggcagctcctgctgctgctcaaagtttagctttgtctctcatccagctcagacttttgctggtcctgatggcctctgcttagctgtattagtacgctcttgcattcctataaagaaatacatgagaaatacctttagttggctcacagttccataggctatacaggaagcatggtggtttctgcttccggggaggcctcaggaaacttttactcaaggtgcagggcaaaaaaaaaaaaaacaaaaaaaaaacaaaaaaaactaccagcactgcactgtgaggccctgatccctgagctaacttcatattattacctctacagcaagtgtccgtgagaacatagatatatttcttatgtgagtacacaatttacagaagaggaactaccctcccaaaccaaaacgtcataattttaatttaccagcaaacctaggttgcttctgtgaaatgatctcatttgctgagttttaaaattgactaaatttcccaatttccaaatgaaaatatttagttatcttgtcttgctatgtgtttttggttaatatgatgattaatttttggtctattacttaatatattccatgattgttgatatggattataaggactcacaaaatagttttcagatgtctttaatttttttacttagtgtagatcctataaatggattagaagtattctattaactcccatgtattcagaaatcgaattggagtggtaaattctgtttgaagtaacaagggatatcaaaggaaaaaaataattttgtgactatgtcttctatacgtaaatttttcaggcatctttatcaatggcttatactaaagacattttctggatcatgggtgacacacagaagacctgtggataagtggcattgtgtacactactgcattttatcatctggttcatttttcaacttttatttctcttaaggatgttttattaactggtgcatcaccaggttaccagtctctggaacactaaacttaccagaaaatacttgttgattgaattaacaagacaacaacattagaaaacagtggtggcttgtttttgtccattgcagtatcttggagagtaaagcctaactctttaattttggccaaagatataaagaaatacctgagaaacacctttagttggctcatggttccgtaggctatacaggaagcatggtggtttctgcttctggggagtcctccaacacttactggcagggtaattttgaagaagtcataataagatggttgttacaattaaatgaaataatcaaagtggaagagcttagttagctgtcttccctaaatgaatcactggcaagtaagagtgtgattgattttcctaccagtcaggactcaccccttgaagctataggagggtaaacctctgaagaccatacaatttagggaacactaacacctcaaaaaactctgtaaacttccttccttccttttcttccttccttccttcctccttccctccctctctctctctctttttctttctttgttcatttctgagacagagtcttgctctgtcattcaggctagagtgtagtggctggattatggctcactgccgccttgacctcctaggctcaagcaatcctctcacctcagcctccctagtagctgggactattggcatgctcagctaatttttttctccttttctttttgtagagacagggtctcatcatgttgcccaggctggtcttggactccttggatcaagcaatcctgctgcctcagcctcccaaagtgctggattacaagcatgagccactgtgcccagccttaagtttttttcatacaggaggaaagaatttggaaagtaggtgtgtgtgtgtgtgtgtgtgtgtgtgtgtgtgtgtgtgtgtgtgttggttagggagccaacacatttttctgcaaagcttgaattctatgcctcagtttttcatttttgttatgtgcaaaataaaatcgtatcctgctatagatttaaacctgtgagcgaatcctactcaaaacctgattcaaactttgtgtagatctttgcctctctgtggcataagaataaattcttctggttttcttccctcagaaaaatggacttagacttcccacaagccttccagaaagaactcacctgcctcatctgcctgaattacctcatagaccccatcactataggctgcgggcacagtttctgtaggccctgcctctgcctttgctgggaagaagcacacactcctgccctgcatgcagggaattgtcacagcaggaagatttcaaccaatattcttctgaagaatctagtgtccattgccacaaaagccagtctctggcaattcctgagctctaatgaacaaatgtgcgggatccacagggagacaaagatgttctgtgatgtgggcaagagcctgctctgttttctgtgttctaactctcaggaacactggggcacagaaacactggctcactgaaggggcagctaaggaacactgtgtaagtgatgactcagagcactttgaaagctggagggcagcacaggtaaagagattaggaggaagatgaagagcacgaggattaatctattctttaccgagtgtcatgtactgcctaggtatcagtgatataactattatcctgctatcaaatctactgataagtggctcatttaacttataggcactcatcacaatgcaagaaatcctctgactgctcctaccatcatggcccctagccatgatatgacttgtctccacactagcagaaactaatcgagtccctatattagggataagtggcatttttatatatatatatatatatatatatatatatatataatttttatatataaattttatatgatatataaaacatatttatacaatatatattatatacatatatacatacatatatacatacatatatatatatatatatatatatatatatatatatatatatatatatcacaatgccaaaaatgttttgtcttcgaaataatcacagtgcatttggagagacaaatgcatctacaaccaggcgacaacactgaaaataaaattgtagcagtttgaataggggattaaatgagttaattttttcctggggttcaaaaaaagaaacagcagcaaaaaatggtacttaagattgaaagttggccgggtgcagctactcatgcctgtaatctcaacactttgggaggccaaggtgggcagataacctgaggtcaggatttcgagaccagcctggccaacacggcgaaacaacaccattactaaaaatacaaaaattagctgggcatggtggcaggtgcctgtaatcccagctactcgggaggctgaggcaggagaatctcttgaacccaggaggcagaggttgcagtgagccaagatcacgccattgcactgcagcctgggtgacaaaagcaaaactccatctcaaaaaaaaaaaaaaaaaagaaagttctgggttatgacacagaacaaatgcaacatgaatatgtcatggttatgaacatgtagactactcaagattgtgtatttttaaaataatagaatactaggttaaaaaatgagcattacaaaatgaaaaataagccacaaattagcagaagataattgtaacacataaaaacaaaggattaaatacaatggtaatgtaatgatagctattcttacaaagttgtttctatgtctcaggtactatgctgaacaacatacgtgcatcttgaatgcgtgaagaattcctatataagaaaaacacaaacaacaacatttaaaatgagcaaaaaacccgaataggaatttcacagaagagaaaacataaatggcccataaacataataaaagatactcaactacaattctaatcagggaaataaatattaaaaccccaaagagataccacttcatactctaggaaaaacctaaaaggctgtgaatatctagtttcattgaggaagaacaatgggaagactattcactgctggtgagggtgtagattggtacaactgccttggagaacagtatgatgccactcaatagagctgaacacacacatgcccaatgaccaagcaattccactccaggtacatactggaaaaatactcctgcacaagtagaataggagacactgcataacaaagttcactacaacatgaggctgaggtgggaagatggcttgagaccaggagttcgaggctgcaccagtagctgggactataagcatgtgtcaccgtgcctggctaattttttgctgttgtggttgttgttagagatgaggtcttcctttattgaacaagctggtctccaactcctggcttcaagtgatcttcccacttctgcctcccaaagtgctgggactacaggtgtgagccaccatgcccagccaagttctgcttcttaacctgaggtagatactttgatgtttcattttgctttattgtacagatatactttatattctcatatgtgacacaagtcaaaatttaaaaaaacaatttaatgtttattccctttagatgaatgatgggcaaatttacataatgaattcattactgaaacaatgtatagatttcagactaggaaagtaactatttataaaagaaaagcttaaaacctgaaacagaaacaaaatcctgaaactgtaaaattgagtcaaactaaaatttaaaaaacaaagcaatgatataaagtatcatttgtccaaatgtgttctacaaaacgcttttttcttaaatatgtctgaggaaaaacaggttctaggagtaaaatatgtttgaaaaatgctgagttaaacaactgaacctatgaaggaaggaatagaacttctcaagctcttgactctggaatcttttttacatggcaattaacaccatgcttcttcttggatttgtatttcagataaacacaatctgggaaacattttataatacagagggccacaccagattgaatattgcccccaggaatgaaatgaaaacaggaatggattctccagtaagaggtacccagatatcctaatcttcagtagctgacctaaaccctggacaagtgggatcaaatcccataaccaaacacaactttttaggaactaagtggataatcactctgtgttgtatgaacatgtgggcagtgtgtttcctacacagcttaaaagtgcaacaaaaaaagatctaggtgtcatataaagaatttctaccactgttagggtaatggtggactgacaggcagaggggctcagatgtgacttaagtaaagttcaatagaagcttccagcacagatattcatgtttcaaattggaccactcagttaaaaagttttcccattagacttcccctaatcaaattagaaattatctaattttctaataaagttttccccaggcacaaggaatctgtgaactggacctaaaaaattcttcgtaatgtacttttattaccataaaagatgcacatttattttaaaaacttctctacaccactatcataaacctttgcacacacttatttcttttggaagctaacttctgagtggtaatgaaatatattcttaagaaaaaagtccgacacaatgcctttgcgtcttaaaatatgttaaaatattatttgaaaagagtcaaacatctgtcttttcagggtatcacagggcgtcaaactggaaaatgtggcactgcctggagtttctacctggtgaagggtggcagacttttctcttcagaggactcttgacagggtagcatccattatcttgccaatttactacaacctaggcccaatcctcagtcttataggttcagaaatttatttttatcagcatcaacagggtagctacattgcttagaagcaaacaaaattaaccatgcttcaatagaaatcaggatatagatgtattaatacagaatgacaaatataactgtgacagaaataggaatgcctgtttatggtcatatacggccaatactttcattacagccaaactcatatatgcagccaaataagaggcccctggatacacagggaatcagaataaaaaaagaagaactgaacatttaatagtcttctttcattcaatcaataattttttttaattaagcaactactatgtctgggtaaccttctaggtcctggggatacagaggtctctgcttacagaagtcatatgtaagtagcaggtgaagagtatgtgtttcacagaagtttattacaatatattaacaagagcaaaaaattttggaagcaatctaaatgttcaataatagagctccaattaaataacaataaatccaaataatgaaaaataatgcagccctttaagaataagcacttgcaagccgtaattcatgacatgggaaaattatcataatggaaaaagaagcaagctatatacagtgcatgatcctatacacacacatacatacatacatatttcctatccctttatatgcataagaaaacaagcgggaggaaagtcgtatctttagtcaagtcttgtttactaacgtactattaatgattatcttttctttttctttatacctttttgcatttttcaatttcctaaaatagccttacatgccttttatcaccaggagaaaaattacttctaaagtaatttcagtcaacatgcatactaagaactcttcagatttatctgttagaagctgtgcatgaatgccagtccttgcatctgtcttggaactcacagagagctcttttcccatggctttaagcaatactcaaaaagactagcatacctgaatttcctagtcctatgtttttttcatccaacagccagtcttgtatttctagctgttttctaaacatttcaaccaaaccattttacagataactcatacagtcatcctttgatatgcatggggaattggttccaggatcccccttgtataccaaaatccatggatgctcaagttactggtataaaatagtgtagtatttgcatataacctacacacatcctcctatatactttaaataatctctagattacttaataacaattaatacgatgtaaatgttacgtaaatagttggtataccatgttgttttttatttgtatcattttttatcgttgtattgttttttctgacaattttgttccacagttgtttgaatcagtggatgcagaacccatgaatatggagagtcaattgcattttattatgcccaaaggtaaatgcataatttttccacacagctaatcttctagcaaccccattgctgtccatggcaaacaggcttagttaatctcgccctttcccgtttcaggttcattatacaccatggaatactatgcagccataaaaaatgatgagttcatgtccttactagggacatggatgaagctggaaaccatcattctcagcaaactatcgcaaggacaaaaaaccaaacaccgcatgttctcactcataggtgggaattgaacaatgagaacacttggacacaggaaggggaacatcacacaccagggcctgttgtggggtggggggaggggggagagatagcattaggagatatgcctaacataaatgatgagttaatgggtgcagcacaccaacatggcacacgtatacatatgcaacaaacctgcacattgttcatgtgtaccctagaatttaaagtataaaaaaaataaaaaaataaagaaagaaatagatgttctgtaaaaatatacacaatttttacagacaaatacatttataagttgtttttatcttaaaaattggggatatttcatatttataactaaatattgagccttaagttttcttggccatttctaggctaataaactaagaatcatgtaaactaagccaaagtagaatagacataaaagtcctgaacacttcaacttcctatccttcaagaagtatacctcgcaaagctcatttgagagaggaaaagctttcctccaccctcggttttacagtgctgaggcttctcatcacatttctatgacttgtagcttaaatccatgttacatggtcactggcattgttagtgcttctcttttaacactgtaggaattaatcaatttggtggcatatttaattaattctatcactagaggattgtaaaattacatatatgaatacctcactttagaggccacttaatttttttccaaggggatatttgactatatttcacttgtgtcttatttaatgattttataatttaaaccctaaattataaatctagaatttagaaagtatatttccccactggattacatttttggaaatattactttatatgtgcacaaatattacaaaatcactgtagacacctgaaaactatattatcttttaaagacaatatttacattaaactggtataacaaaattgtttggtgcattttttccagtacattttgtgtatattacatgtttaacctttttttattcagcaaataatttttgagtatctactaagtgctaggttctgcattactaactgaatttaaagagtgaaataacagacatggtctcagacaataaaaattaacattaggtcacttatttatatatttttaaatggtaattatgaaaactttttgagatttttaactagataacattataataacgcacttgatgttgttaatagttgccagtgagcaaaaaagaaaataaaaagatggttttattcaatatacactttaaaattgcagaaaatagtcaagtttctctgctttgcagttgaatgtctatgtgtttttctctgcaacttggcttttgtggagtgaaacaattattcttccagcccaatgaaggcagacgagtaacaataaatctaatattttaaatgcttatcaaaagatagtaaacacattatttcagaatactgagttcaataagttgacctacaaaaaaagccaaactgacagtattactgaataaggaaaggcccaaagagacaaaatactttttattttgtaacctcggtatgacacaacttaccctaactataaagaccctaaattaccaagatgggtgcttataatatggagagttacaaagtcatttcacttttagcttttttatttctctcagaataaaaagtgtataaggagttgataaagaagttgatactataagttagtactacaatgacagcacttttcaagaaaagacttttttctctcttacaaatatcatgttagcagtatttgttttctccagaaataatgagtaaataaaaacataagtatgtgggtaattagtgtagtttcttaaataaatgagttaggcaacaggctaataatgtatatttcactggcttttcaatgccaacaatcatattctttataaggcacagagaagatttttctaaagaataagtatgtgaacctgaaaagtaatcaccacttggtagtgacaatatggatagggtgaagggcgtcaccaagaagcaatgaaaagatacatttgcagttaaatttgaaaaccatgatgtttaatacatatagtaataaagaatactttctcctgtctcaaaattattttagaatttaagatagaagctaaaatacctagggataatgatatgactatcaaaaattaaaaattaaaggatattttgagtattataaattaagaatgagaacttattacccaatgaacaggggataattcattatgctccatatccattgaattaaaagacaggcccattacctggataatttgaaagtttaattttatttaaaagtcttgtttcattcatcaagctaaaggattagctcccagaaatattccaggattgcatatccccaactctgtaggaagtatagaaagaatgttataagggccaccatctaaacattattatataaataatttagtaccattccatttgcctttgtagatttaaaaatgtaaatggctttctcatattaggaaacatcacttttcaaaacccaggtaaacatagtatattgcaagagaataattattttctttattaaaaaagaaatactggatgctaagtccaaaagacataaattattttatactaataactactaatattttattcattaaaatataaaggtcaaagatttcaaaatgatctttaaatgattaataacatgttgatctttttcttctttctgtaaacctttttgagtcttaacaatactaaactatacaagcaatattaaatagtatataaacttggattaaaatattcaaatttactagaatgtggacattggaaagaatgaaaataaacagaagcataaagcagcagatataaaattaagaaagcaactaagagtgtttaaagtgcatattcatctgtagtctaatgtctaccataaacaatgactcttctcagtaaaacacaaattgttcatgaagggaaaaagcatgttgtattagagcatattcaacataatttttttagtactaacttgtgcctggagtattattggtttttctattatgaacttatgcacttggtaatttttttcatcaaaattgtatgtacaactccattcaaaagcagtttttggtcgttttttttttttttattttgagacagagttttgctcttttcacccaggctggagggcaatgatgcgaatttggctcacagcaacctagcaaattttgcctcccaggttcaggtgattctcttgcctcagcctctcgagtggttaggactacaagcatgcaccaccatgcctggctaattttgtgtttttagtagagacatggttttgccatgttgaccaggctggtcttgaactcctgacctgaggtaatccgcccaccttggcctcccagagtgctgggtatgggcaagagccaccatacctggcctcaaaagcagtttttaaaagcaaacacaatataacaccgaagttgaaaaatccatgctcactcaaggatgccaggtttaataaattattgatagaatactacatcaaaaataagacaataaaccaaaatataccattaaagatgtatccactcctacaactagagataactaatctatctggtagcaaatgatacttcaatcagtttcagcatgtctgaaatctttaaggacaaaagtgataaaacatgacttcattcttcattagcctcttagaacacttgaaggaaaataatttctgaagcacgaagaggtaaagaggtgtaatctttcaaaaagatattcagtgttcaaaatccaagagtgcaatatcaggctgggtgcggtggcttatgcctgtaatcccagcactttgggaggccatggtgggtggatcacctgaggtcaggagttcgagtccggcctggacaacagggtgaaactctgactgtactaaaaatacaaaaattagccaggcatggtggtgtgcacctgtagtcctagctacttggggggctgagacaggagaatcgcttgaacctgggaggtggaggttgcagtgaaccgagatcatgccacctcactccagcatcagtaacagaatgagattccatctcaaaaaaagaaaagagtgtaatatcggtatacacagataatatactgaatgaaacaaatagaataatttgaagaggtatcttgatgaacaaggagtaattagaaaggttgtatttatgtctttgaaggaaattgcaatgtgagaaattaatactttgactactatactaaaagtttattgctaacatctattgagttattaacgtgtgttaggcagagtaccatataatttacaagtgttatctcatttattgtaggtaaaatgtaatttcaaactctgggagtataaatgaattagatagaataaaattctatttaaatggccatcagtaaatcggtatctaggaacagggtgatacagtgcccaagttttctattcttactaaatgttgtgtttccttttcaatgttttcttggatattgctcttttttggtgattttgattttttttattttagaaaactaataaattgactcttcttggtactgactcgggttttatagaagaaaaagtaattaaattctgtacatttacctttacctcattttttctcttttaaatttactttaattgacatacaataaatgtacatgttatggggtacagagtgatattttgatatatttatgcaatgcgtaaagatcaagtcagagtcattatcatatccattacctaaatcatgtattatttctttgcagtgagaatattcaaaatcttttcttttcgttatttgaaaacacacaataaattcccattaactacagtcacccaacagtgctgtagagaactagaacttcttccttctctccagctgtaattttgtatgtattaagcacatttttcttatactcttctttctcctactctttccaggatatggtaaccaaaactctactatctacttctacgagattaaaaattttagcttccatacataagtgagaacacgtagttatgtggtgtttatatttctatgccaggcttatttcacctaacataatgccctccacttgcattcttgttgccacaaacaacaggattttgttctttattatgactaaataatattccattatatatgtatgtcacatttctttatccattcatctgttgatggacacttttgttgattccatatcttggctattgtgaatagtgctgtaataaacatgggggtgcaggtaactctttgatatactgattttctttcctttggatatatactgaaaaccatatgattaaattaataaacacaataaaagcgtttggcaaaattaaatattcttacatgacaaaaaacttctcaacaatttagtatagaaaatatatgccttaacacaaaggacataaaggacaaatctacagctaagatcatactgagtgtggaaaaggtgaaagattttactgtgaacaagaaaaagattttactggaacaagaaaaggatgcctattctcaccaatcatatttcacatagtgaaagtcttagccaggacaattaggtgagagaaagaaataaaggacatctgaattggaaaggagacagtcaaattgtccttgtttaaagacaatgtgatcttatacatggaaaaaaataagactctaccaaaagcttctcagggtgatacatgaaattaatatagttgcaggatataaatcaacatacaaaaatcagtagcatttctatatattgatagtaaactagctgaaacaagaaattaagaaagcaattccttttacaatagctacaaaaatgtacttagaaataaatttaaccaagtaaaagatttcgacaacaaaaatgacaaatattaatgaaagaaattaaagaaaacataaaaaagcaaagacatccacgtttatagattgaaataatattcttaaaatgacccactatcctatgtgatttacaaatttagtacaatcactagcttgtatttttaaaagcacctttgctgcatattcttaacatattcaatgacaatgcctggatttgaggtattattatatctattttatactgggcacaatataatgttatcagaggtaacggttttgattggtcctaggtcatacagtaatatatacattgtcatttatagacatgctatcttttaatactcaggcatttagaaagttcatttagacaaagttataaaaacttgccttcctttctgcctatatcacctaaaaatcctaatttaagaggtaataacattttttatttgatatacaatttatcaacacaataaaaatctaactatcatgtgcagagtgtgaaaatctcatcagattaaggaacacaaagacatctttttcatattttgaatgtaaaactgttttggaaactgttatttttagaaacagttaaaaacattgtttcattagtttttcatgtaaaattgtgacaaccagcatgaaataactgtcatcacagaagcatggtatattcgattccgaaacatattctttgtaagttttaatatatttatgtattatttatacttaattgtaacccataatgtacagatattatttttccttcaactcttaagaatattcttaaataataaaattaatgaattataatttttgttggttgggaaaaagacacacacgtgacagtgcatcacttcacctcatcatttcatctcatttcatcttatcccatctcatctcatcatttcatatcatctcatcatttcatctcatcatttcatcaaatctcatctcatctcatttccatttcattttcattatttcatcatttcatttcactatttcatttcatgtaatttcatttatttcattatgtcatttcatatcatctcatttcatttcatgtcatattttttatatcatttttcgtatcatttttcatctcatttcatctcatgtcatattttttatatcatttttcgtatcatttttcatctcatttcatctcaattcatttcatctcatcatttcatctcacctcatcatttcctcctttcttttcaacatttcatctcatttcctctcatctcatttcaattttatttcgttatttcatctcatttcattatttcacctaatttcattatttcatctcatctcatctcaatttatctcatctcatcatttcatctcatcatttttcatctcatcatttttcatctcatcatttaatctcatttcatctcatttcagctcatttcatgtcacatctcttcatcatttcaacatttcatttcatctcatcatttcatctcatctttcaatttcatttcaatatcatcaattcatcatttcatttcacttcattatttcattatttcatttcatttcaattcatctcatcatttttcatctcatcatctcatttcatcatttcatctcatttcttctcatttcatctcattttatctcatttcatctcatctcatttcaatttcatttcattatttcatttcacttcatttcatttcatctcatcactttatctcatctcatttcatcaaatcatttcttctcatctcatctcatttcatcatttcatctcgtttcatctcatttcatctcatctcacctcatcatttcatctcatcctttcatttcatctcatcgtttcatctcacctcagcatttcatcatttcatctcatcatttatttcatctcattttatctcatttcatctcatatctcaattcaatttcctttcattatttcatttcatctcattcatttcatctcatttcattacatctcatttcctctcatcattacatctcatctcatcttatcatttcatctcatcattgcatctcatcatttcatctcatcattcatctcatttcatctcatcatttccatttcattatttcatttcatcatttaattttatcatctcatttaatttcacctcatttcattatttcatttcattttttcatttcattgtcatttcatttcatctcattacatttcatctaatttcatttcacctcatttcatctcatcatttcatttcatctcatcatttcatcttttcatctcatttcatctcatcatctcatcaactcttttcatcttatctcatcatttcatttcatctcatcatttcatctcatctcgtatcttatctcatttcaatttcgtttcattatttcatgtcatctcatctcatctcatcatttcatctcatcatttcatctcatcacctcatcatttcatcattttatttcatcatctcatcatttcatctcatctcatttcgattttatttcaatttcatttcactatttcatttcatctcatcatttcatctcaccatttcatttcatcatctcatctcatcatttcatttcatcattcatctcatcatctcatcattcatctcatcatttcatatcatcattttatctcatctatcatttcatctcatttcatctcatctcattccatcacatttcatctcattttatgtcatcatttcatgtcatcatttcatcacatctcatctcatcatttcatctcatcatttcatcatttcatctcatttcaactcattgcatctcagctcatttccatttcattattccgtttcatcatttcattcattatgtcatttcatctcatatttcatctcatctcatcatttcatctcattttatctcatctcatttcatcatttcatctcatcatttcttatctcatcatttccatttcattttcatttcattatttcatcatttcattattttatttcatctcatttcattcatttcattatgtcatttcatttcatctcattacatttcatctaatttcatttcacctcatttcatctcatcatttcatttcatctcatttcatcttttcatctcatttcatctcatcatctcatcaactcttttcatcttatctcatcatttcatcatttcatctcatcatttcatctcatctcgtatcttatctcatttcaatttcatttcattatttcatgtcatctcatctcatctcatcatttcatctcatcatttcatctcatcacatctcatcatttcatcattttatttcatcatctcatcatttcatctctcatttcgattttatttcaatttcatttcactatttcatctcatcatttcatctcaccatttcattccatcatctcatctcatttcatttcatcattcatctcatcatctcatcattcatctcatcatttcatatcattttatctcatctatcattttatctcatttcatctcatctcattccatcattacatctcatttcatctcattttatgtcatcatttcatgtcatttcatcacatctcatctcatcatttcatctcatcatttcatcatttcatctcatttcaactcattgcatctcagctcatttccatttcattattccatttcatcatttcattcattatgtcatttcatctcatcatatttcatctcatctcatcatttcatctcattttatctcatctcatcatttcatcatttcatctcatcatttcttctcatctcatcatttccatttcattttcatttcattatttcatcatttcattattttatttcatctcatttcattatttcatttcattatgtcatttcatttcatctcattacatttcatctaatttcatttcacctcatttcatctcatcatttcatttcatctcatcatttcatcttttcatctcatttcatctcatcatctcaacccttttcatcttatctcatcatttcatcatttcatctcatcatttcatctcatctcgtatcttatctcatttcaatttcatttcattatttcatgtcatctcatctcatctcatcatttcatctcatcatttcatctcatcacatctcatcatttcatcattttatttcatcatctcatcatttcatctctcatttcgattttatttcaatttcatttcactatttcatttcatctcatcatttcatctcaccatttcatttcatcatctcatctcatcatttcatcattcatctcatcatctcatcattcatctcatcatttcatatcattttatctcatctatcatttcatctcatctcattccatcattacatctcatttcatctcattttatgtcatcatttcatgtcatcatttcatcacatctcatctcatcatttcatctcatcatttcatcatttcatctcatttcaactcattgcatctcagctcatcatttccatttcattattccatttcatcatttcatttattatggcatttcatctcatcatatttcatctcatctcatcatttcatctcattttatctcatctcatcatttcatcatttcatctcatcatttcttctcatctcatcatttccatttcattttcatttcattatttcatcatttcattattttatttcatctcatttcattatttcatttcattatgtcatttcatttcatctcattacatttcatctttcatctcataatttcatccatcatttcatttcatttcatcatttcatctcatgatttcatctcatctcattatctcatttcatctcattatttcatctcatttcatctcatctcatttcatcatttcatttcaccattacatctcatcatttcaactcatctcatttcaatttcatcattacatttcataatttcctttcattatttcatttcatctcatttcattatttcatttcatttttcatctcatcatttttcatctcatttcatttcatcatttcatctcatcgttcatctcatctcatcattttatctcattatttcatctcatatcatctcattacaatttcattatttcatatcatttcattatttcatttcatctcgtttcatctcatttcatccatcatctcatttcatctcattttatctcatctcctctcctttcaatttcttttcaattttgtcatttcgtctcatcatttcatctcatcatttctactcaccatttcatctcaaaatttcatctcatcatctcatctcatcatttcgtcatttcatctcatcatttcatctcaagtcatcatttcatctaagtgaaatgatgtaatggaatcatgaaatgaaatggataggatgccctcagtgatgttaaatttaaaaattgtttcttttcatgtatgcatttttatatttatatttacttatagttattactttttatttatatttttacttatttctttatttataaacaaggtcctgttctgtggcctaggctggaatgcagtggtgcattcacagttcactgaagcctcaagcaaacctcccaccttagcctcccaggtagctgggaccccaggtgcgcaccaccacacctggttaatattttattatttgcagagatggagtcttgctattctgcccaggctggtctcaaactcctgggctcaagcaatcctcctgcattggcaacccaaaatgctgggatgccagatatgagccacagtgcccaacctatttatttatttatttatttatttatttaataaagacaaggtctcactatgttgcccaggctggtcaactcctggactcaaatgattctccaaacttggcctctcaaaatgttgggattacaggtatgagccaccatgcttggcctaaaaatagtattatatttttgtatcatataattttcaattaggtattatgaatattctgtacaggaaacacacccttaattacataagaataaacatttgttacactgagaaaaatctaatagagctaaaaataaaaattaatttggaaaggtcattagatactgatacattcttacgtttatacattctttcatatattcatatatccttttaacagtatcaatggtttggagttacgtgtacaaagccatgacccatatgtaatacaactaataacaggcacttacaattcaaggcatattatatacaaagctttaacttcttatcaaaatattttacttttttctttctgttttggcagatactatgaacacaacattcaactcacagacaccatggagcccttactaagcataaagtactgtgaaaggccagggctaggacagaactgagacagggccagggataggacagaactggggcagggtcatggccagagaaaaaccaggggcagggtcacagccagggacatgagaggaccaaggccaggtccagaagcagggaagaaccagggccagggcagggacatggcagggccagggccatggcaggatcagggtcagcagaaggccagggcagggctagggtggcacagggccaaggcagggcagggtcagtgtagagcaaggaacgggccagggtatggcagggcagggacagggaggtccagggccagagtcaggtccaggacctggacagggcagggccagaaacatggcaggaccagaaaggggacagggcaagggcaaggccagagaaggaccatgggaaaaacatggccagggagggtccagggcaagggcaagtccagggcagaaccagagccagagcaggccaaaggcagggccagggcagggcaaggccaggatagggcagggccagtgtagggtgagggtaggaccagggcgagttcagggccagggcaggactaagatagcacagggctaaggcagggccaaaaggaggggccagggccaagcatggccagtgtcagacctggggattgtcagggtcagggtcaaggctggtccagggacagggccagagcaagggcagggccagggagaaagcagaaccagagaggatccagagcaaggccagggtcagggcagaaccaggaccaggataaggcaaagccaaggccagggcagggcaaggccagggcagggcaacaccagggaagggcaaggccagggtagaaaaggccagggtagggccaggccagggtaggagaaggccatggtagggccaaggccaaggcagggcagggctagggtagcacagggcacggccaaaaacagagcagggccatagcagtggcaggactagcaacagggctagggcaagcgctggaccagagcatggtggggacaatatagggccaggacagaggatggcaaggcaggtccagggccatttcatggactcagtaggcctggggtcaggccagggcagggcaaaggcaaggccaggaagaaggcagggccagggccaaggcagtgccagggcagggcaggaccagtgcagggccaatgcagggtgagggcaaggccagggcatggaagggcagggcaggatcaaggaagggccaggagagggccacggcagggtcatggcgagaacaagggtatggctggggtcaggaatatggtaggatgagggctgggcccaggctggggcacgcagggcagagcatggtctgtgcaaggcatggccagagccaggccatagagatgggagggcaacaccaaggcagagtcagggtagatccagggctgagcagagtcagggcaggtccagagtcgaggcagagctagggcccaagcagcgccatggtagcaccagggcagaggagggcagggcaatgcaggactgggccatggcagtgcctggtcaactccggggcagggccagaagcaggacagggccagggccaatgctcaggccagggacagggcatgacaggacgtgccagagcagggctgggccaacgttggggcagggcaaatcagaccaggacacctccaagtccagctctggccctgccttggccctggccccttcctggcctgaccttgtccctggccctgccctatccatgccctgtgtgtttgaccagtgttttataaccagaatcctacaagaaacttaaattagttctttttgtgcatttttagtagagatggggtttcacaatgttgcccaggctggttccaaactcctgagctcaagccatctgcctgccttggcctcccaaagtgctgggattacaggagtaatctggccaagtatttaccttctttttgcctgtttcctacatttggaaaatggggatgctttaagtacctagcatatagaattattatgagaatcaatgcctcacatatttacatgttgataaaattatactcatagaacactactggaagcaaagatagtattagttaaaatttagtgattactgcaagtattattactattacaaacaacatagtatagacattactactactatagttatcttaaaaatctaaaataaaaattttagtaatagcctaaagtaatctctcctgctctgccctggctcagccctagtgccggctctgcccctagtcctactacatccctggccctgacccttccctggtccagccgctgccctggcccttcccatcttcaggccttaacatggccctaccctggtcctgaccctgccctggtctggtcctgaccctggccctaccccagagaaggggtatggcagagccagggaagggccggggcaaataagggacaggacacatccaaatccaggaacgggccagggccatgacagagccagggcgagtccttggcagggccaggttccaggccaggaccaggaaaatgtcatggcagggtcactgtatggccaaggtccaggccaaagccaaggcagtggcagggtcaggtctgcataagggcaggaccagagccagtgatacggcagggccagggccagggccagggctgtgccaggacagaacaagagcagagcagggcaggaccacagccaggccatagagagagtagggcaaatgccaaggcaatgccagggtagtgccagggctgaggcaaggtcagggaaggtccagggctgagtcaaggctagaaccaagatggggcaaaggccggggcagatctagggcacaagcggggcagatctagggcacaagcagggcaagctagggcagggcaatggcaagaccaggccatggcagggccagcccaggatagaacagggcacaggcagggcagggccagggccacggctggggcaggacaaggaccaggaccggggtccaggccagggcaagggtatggccagggcagaggtagggccagagccagggtctgggcaggaccaaggcaggtctattgcagggccagggttcagaccagggccagagcagggctgggacagggccagggccagaaccaggaaagggcaatgtcaggacaagggccatggcaggaccagcaacggggctaggaccaggacagggacagggacagggtcagggctagggccagaatagcatgccagggtagagccaggccaaattagggccagggctgggccagggtatggccttaagtagtgaagggccagggccagggtccatgccagtgccagtgccggtccagggcagacgcagggccatggccaggtctaggacaaggctgtggcagggccaaggtctgggtcagggtcagcataagaccaggacagagccaggggagggacagggccatggtaagaccaggttaaaccatgaacaagacacctgcaaatccacttcagggccagggcagggccagttcagggccagggtaagggctgccagggtcattggcagggccagggccatggcaggaccagggtcaggagcaggggtcaatgccaggccaaggccacagataggaccaggtctgtgctagggccagtgtgagggccaagacggggtcagggcagggccaaagggagggcagggccagggcagggtggagcaggcccagggtagcacagggttaaggtagggcacgaccaaccagggcaggtctatggctggggccggggcagggccagggccggggcagggccagagccagggcagggccaagacagtggcagctccagggcagggccagggttaggaccacggacatgtccaaggccagtgccagggcaagggcaagggcaggggcaggggcagggtcatctaagaattagggacaaagccaggcccagagctgggccaggaccggtacctgcagggctagggtctgggccagggccacaaccaggtctgtgctatggccaggtccaacacagtgccctggtaaggctagggtgaaggccaaggtagggccagggcagggtcaaagccaggctagggccaaggcagggccaggaaagcatagggccagggcagggcagggccaggccagtgccaagacctgggcagggccagggccagggccatagaaacggcctgggcaggaccaggtttggggcaggagcaaaacaagggaaaggacagtgcaggttcttggcacagccagggtccaggacagtgtcagggcagggccaaggcagggtctgggccatggtaagaccagcaacagggctggggctaggtcagtgacaggaccagagtcagggcaagggccagagcagggcaaggccagggtagggccaggcatttcagggtcagggccatgggagaaccagggcaaggtctcaagcagggaagggccagggccaggacaggtccagggcagggtcatgacagggccaggggctgcattagggcaagggcagggccagagcaaggtaagggtcagggccaaggctagggtagggacagggcaagaaatatggcaggaccaggggcaatgccaaggccaaggctgagtcagggctgagtcagggcagggcagggcagggcatggtatggccagtgcaggacaggacaagagccggtccacagagagagcagggctgatgccaagaatgagccaggctagtgccaaggctgaggcagtgtcagagcatgtgcagggcagggccggggccagggccagaaccgagccagggcacagccaaggcagggtagggcggggaaatagcgtggccgggtcagtactgggacagggcagagcagggcaaggcgatggtaggggcagggcagagacaggccaatgcagagccatgttacaccggggccaggacacctccaagtccacttcagggccaaagctatggcaggacaaagaccagggccagggtcagagccaggtctgtgctgggcctagcgaagactagggtgagggccaaggcaaggccagggcagggtcaaaggcagagtagagccagggcagggtgatgacacatccagagcacagcagggcagggtgatggcaagaccaggggcagaccactgccagctcagggccagggaaagaccagtgcagagccaggaaagggtctgggtctgggtcagggccaggaacaaggcagagcagggccagggccatggcagagtcagggcaggtccttgacaggaccaggttccaggccagggccagggcagcagcaggggcagggcctggataagggcagggtcagggatatggcaggaccagggctagggccagggccaggccatagtgagggcagggcaaaagccaaggcagggtcagggcaggtccagggcaggtccaggaagcggccagcaccaagcggggccaaggcacaaccagcgcagggtaaggcagggcaatggcaccactgggccatgacagggccaggtcagtgccaggagagggcagaacaggaaggcccatggtggggccagggcagggatgggccaaagcagagccaggacatttccaaggccaggtcagggccagaacaggagcaggaccatgaccactggcagggccagtgccatgacaggaccagggtcaggacaaggggcagggccagagccagggccagagccaaggtcaggccagtgcaggttcagggcagggccagtgccagggcaagaccagggcagggacagggtagcacggggccaagacagggtcaggatgggaccagagcaggacagggctgagagtccaggtaacagtagggcaggtacagggcaaggcagggcagtacagggccagatccacggcaggcacagggcaaagccaggcccattgccaatgcaccagccctccctacaaggctcctaccacctggccactgctgcagcccgtccatcgctgtaagcctgactcccaaccctgcctgcagccgcccgccctcctagcgtggccactctcctaccgctctggcgcactgcagtctccgtcactgccacccacctgcagcgaggtgagccgtggtgttgcaggctctaggtgtctcctcctcctcctggcatggagcagctgggcgggcaaagccagaaaagcctagaggaagttgtgaagagtggaagcgttagagcctcaagttgtcatgccggccactgggtggcaggggccagtttcagcaaaggcactcacacccaccctccaaagtccagcctctccttttggcccaagctggccgggaactggggtctggggtgggtgctggagacaccacagcacccagctccccactccacaggaaccactgggcccaccggggctgcactcctcggggaacaggagaagcagaaaaattcagacccagccagccctccgcacccaggtgctaattcctgttccggatgcctccacacacagggccctgttccccgtggtgtccccaggggtgcctggcagcctctgaggcacagacccagagtgcacaggcccaggaaccacggtgggtgtgggggctctgccatgctcaggattcccatgcaaacgctgcgtgccctgccgcactccagtatgaccaagagtggttcgccctctggagtgtggagtcagggagaggagaaccactccttccttggatgccaactctgttgactgccgccagcagtgcagcccctgatagcaccgaactcgcccccgctccacggctagtcctgccctcaatagcgccccccacctccgtcccccaatgccgccagtagcatatacccgatatgccctaacctgtcctcctccatgggcattgcagccccagaaagcacccataacccaccctccctgctgtgggcagtgcagtcctgtgcagtgctaccaaccagtacccctaatgcaggcaatgacaccctggatagcgcccccaacccaccccacactgcgaaaggtgcagccctggatagcccctgtcctaccactctggtcatgctgcagtctctgtcactgccaccaccaactacagtgaggcaagccagtgggccgcaggctctagctcccagcagccaggcatggagcagctctcgctgatggccggctcctaccacactgaccatgctgctgtctgtctccgtggcaatcttctttcactacaaagaaataaaactaggtatcaataagaaaagtaattttggaaacaatacaatcacatggaagttaaacactaccctcctgaataaatgacctgaataaataaaggtcaatgaagatactaagacagaaattcaaaaatttcatgaaacaaagggtaatgaaaacacagtataccaaaacttgttacgcagaaagcagtacaaaggcagagatttacagctataagtgcctaccatccaaacaaaagaaaaacttcaaataaacaatacatcttaaagaactagtaaagtaagaacaaactaaaccgaaaataagaaaataaataagatcgtagcagaaacaaaattgaaataaaaaacacacaagattaaacgaaaagttggttttctggaaagctaaacaaaattgacaaacttttaaccagcctaagaaaagagacaagattcaaataaataaaatcaacagattaaaaaaaggagacattacaactaatacttcagaaattcaaaggatcataactggctattatatgccaataaattggaaagcctagtagaaattggcaaattcctagatgcatacaacctacttaggttaaacaatgaaaacatccaagaccagaacagattggtaacaagtaatgagattgaagccatcagaaaaagtctcccagtaaagaaaagcccaggaactgatgatgtcttcactgctgatggcttcacaccaaacaatttaaagacctagtacaaatcctgctcaaattattttgaaaaacaggagggaatacttccaaacttattctatgagaccattattactgtgatacgaaaatcagataaaagcatcaaagaagaaaactacaggacaggatctctaatattgatgcaaaaatcctcaacagaataccagtgaatcaaattcagtaatacattaaaaagataattcatcatgatcaactgggatgtatccctggaatgcaagagtcactcaacatacaatgtgatacatcatatcaaccaaataaacgacaaaaactgtatgatcatgtcaactgaaaccaaaaaagcatatgaaattcaacatcccttcatgctataaatcctcaaagaaacaggcacagaagaaacataccgcaacataataaaaactacaggaaagacacccacagctagaatcatatggaatggggaaaaatggaaagcttttcctctaagatctggaacatgataaggatgccccctgtcaccactgttgtttaacatagtaccagaaatcctagctaaagcaatcagtgcagcccctgatatggcccccaacccaccctgccccctaccaccagcagtgtcgcccccccccaatagcacacccaacataccctaacctccccgcctccccgcaccatgggcattatagcagcccatagcgccctcaacccaaaaccgccaccccccccccacagccacacagtgcagccccagatagcacacttaacccacctcactgttgccagcaatacagtctgggatagtgcccccaaccggctccccgccaaaggcagtgcagccccggtttgagcccccaaaccgcccccccccccgcccccgggcaggcagcacagccccagatagcacacccaaccagccacccaagacgggcagtgacgcctgagatagggctcccaacccgtcccaggccaccagcagtgcagcctggatggcgcacttaccccaatgcctttctacactggctggctgcagtgtccatcgctgccaccaaccacaaacatggctgcaaacaggaaggattttattcaccgtcgatgcggccccgagttgtcccaaagcgaggcagtgccccaaggtctatgcagagcagaacgcagctccgccctcgcaatgctctccgggtctgtgccgaggagaacgcagctccgcccttgcaaaggcacacagcgccggtgccggcgtggcggagaagcggacagcggcggagaggcggtcggcggcggcgcggcggagaggcggtcggcggcggcgcggcggagaggcggtcggcggcggcgcggcggagaggcggtcggcggcggggcggcggggcggcggagaggcggtcggcggcggcgcggcggagaggcggtcggcggcggcgcggcggaggcgaggcgggcggcggcggcgcggcggaggcgaggcgggcggcggcggcgaggcgggcggcggcggcgaggcgggcggcggcggcgaggcgggcggcggcggcgaggcggacggcggcggcgcggcggagaggcgcacagccgcggagaggcgcacagcggcggagaggcgcacagcggcggcgcaggcgcggagaggcgcaggcccaggctccactccccagctctgaaaactcatcctggtcagagttcagaaggacatgtggagtataaggtcagatgcggagataaagggagatggtgtggccctcctgcctgggggtgctgagcaggttgctggaggcggtgatctcactctgaaggagacagacacagaaatgtgtgtacagttgatggtgagcatctgagttgcgtcttgttagtgaggccaggagtgcctgtgtaagctggaacagattaggtatatgatttgtgaaacggagtttcatcctagatcttcatctagtcaaaggactgtttcctgattaggcattagcttagtggttgctagtctgtgttgacctttgaaaggcatgactaggctaactctgaagtttctgcttcacaccatttacaatttaaaattacctagagccttgtgggccattggaagagactgaatgtttcactctgaaatgggagtccttggagggttttgagcagaggagagacattcaggtaatcagatcactctgccaagacatcagtccggtagagatcagtccggtggcacaaaccagagggctagcagtggagatgagacaaagagtcaaacccggatagagtttatttggaagctgggtcagtaggatctcctggtggactgaatgtggggtgtgtgaggaaatgaggatggcgactggaagttcctggaaggatgggttgttgcaggttagataggaaactgtctgcagatgcagttttgggaagatgatgtttgtttcggctgggtatcatgcagacaagcggagtgtcaagtctggagagacaggtctggccagggacttagatgtacagccctcagcatgtagatgccacttaactctgtgaggtggccggggagtgagtgcagagtgactgggaggagcaagactggcatgggcgagatggggcgattgcggccgtgaggcctgagcagtgcctaggagggagagggagaagcagtgtgagcctgcaggcacgcaggagtccagttgtacacggaggcgaaacactgttcagatcccgctgcagtgttaactatggtaaaggcagagttgaccaccggaggagtctttcagcgtggaggccttcagcgatcttggcaagcaccaattttcatggatgtaggagaatgggagcagaggaactggaggctgcaactgtggaaaacttttgtggggttttgctgcagagagaagcagagaaatgaagcagtttttggtggaagaagtggaatcaaaaggttttgagatgagagagagaacagagggaagagctgttggaataaagtccaggaagagtggatggtgtctagtgagcaagtgatgtgtggccctgagtagaggcatggacaaatcatctgtgcctgagctgcccgtagaactttctgtgatcatggagatgcacatctgtgcttcccaatattgtaacactggccacaggttgatatggaccacttccagtgtgactagtgtgattgaggaactgcattttaaatattatgtaattgtaattaattttaatttaaatagccacacatagctcctctatggggcaggtcagagctctgataaggctggatatgggaggaaaccctggtatagggttgaccgtagaggttcttttggttttggagtgaatcaggaaacagccatcagctgagtgaaggtgagggtggtggtgggtgtttgaagacaagggaaaagtgtgaaagaattatttggagaggaaggaaagaaagtgtggactggggatgtttccaatgtttgagcacgcagggctccacagttatctacatttgctgtcccttggagcaggagagaagaaaatggttgggacatattctgaacagactgtagaggtaaaatgtgtagggttttttttgttttttttgttttttgagatggaatctcgctctattgcccaggctggagtgcagtggcacgatcttgactcactgcaacctccgtctcccaggttcaagcgattctctcacctctgcctcctgagtagttgggactacaggcacgcaccaccatgcccagctgattttggtatttttagtagagacagggtttcaccatgttggcgaggctggtttcaaactcctgacctcatgtgatctgcccgcctcggcctcccaaagtgctggattacaggcatgagccactgtacccggccaaatgtgtagtatttttaataggataaagcctacataattctgtccacagttcctttacttagaaattgctcatttgttcatgttaatcctatgtttattacaaataacagcatacaggttccccccccccaccccatcatgtacagctgaatcacgtagaatttgaagatcaagatgatgaagccagagttcagtatgagggttttcgacctgggatgtatgtccgcgttgagattgaaaatgttccctgtgaatttgtgcagaactttgaccccctttaccccattatcctgggtggcttgggcaacagtgagggaaatgttggacatgtgcaggtgggtccctttgctgcgtatttggtgcctgaggctctgtggatttcccctccatcaatcatcttaccctctcatccccctcagatgcgtctgaagaaacatctctggtataagaaaatcctcaagtcccaagatccaatcatattttctgtagggtggaggaggtttcagaccatcctgctctattatatcgaagaccacaatggaagacaaaggcttctaaagtatacgccacagcatatccattgtggagccgccttttggggtaaaatatgattacaataacttgcctattgccgagattaaactttacaggctgtgttattttagctttgtgcttttcctttcataaaattccactcctaagatgtttctcttttctgggagcggggaggtggtttggagtatatatgtacatctatatccaaatctaagtgtccatatccagtatgttaaactagaatctaaaatttctggtttgctatatttctttttttccttttcctttaagaccctatcactccacagggaactggtttcttggcaatacagtctgtcagtggcataatggtaactatcttggatgatttcttttacagattggtttgagaaatatatcctgaatgtgggttattatgtacatgagactttaagttgaaaattactcatttttattaatataaagtaaatttccctttgcttttaatcttcgtacatccttttcagtagggtgtgggattagaggaggggaggtggaagaattataatggtacatttcctatttttatgcatcttttgcatttatttatccaagcaagtatttaagcagtgctcaccatgtgctaagcactatatgaggttatgaggagccgtcagagaccacccagacacaagactccctgcagctgtgctggggtagcagtctgttcactccattttcatttgaccagtcaggcagggcagggtttactggtcccatttaacagagaagaaagcagaataatgagcagatggaatcttccctggaggtccaaattttaatttcctaaacattgcaactgtatttttcttttccatttcgttccaaataaatcattatagtaaaattacattcctctgaaatcactctcaggaaagtactcaagtagcctttttttttctttctttttttttttttttttttttgagaccgagtcacactctgtcttccaggctggagtgcagtggcacgatcttggctcgctgcaacctctgcctcctgggtttaagcggttctcctgcctcggcctcccgagtagctgggattacaggtatgcaccatcatgccgagctaatttttgtatttttagtagagacggaatttcgccatgttggccagactggtttcaaacttctgacctcaggtgatccacctgccttggcctcccaaagtgctgggattacaggtatgagccactgtgcctggcctcaagtcacccttgttagtttggcttaccaactttaaagttttggattgcttttgtcaaaccaatgggttgcaagttcagatggtctctcttgtttttcttaactaattgtaagtaaaattcactttggtaatttattgtgtcacatagaattgaagtttttctcttgctaatattattcctattttcaaattttggggctcctgttagcctgattttcagatagctgccacaggagttgtccttgatctggataaatccataaaaattgtgaagaaattaaagctaactggttttccatataaaattttcaagaacacttcatttattaaggtctgtatatctatatattctcatatttataaatgtccatattgtttgagaaaaggaatgaaatacctctaaaatgtgggcctcttatttttagaaaagtgtttgaaatcttttataaacttcatattttgtttgctcctttatattctgtattacttaaatatgctcaaaaaagcagtggtaaacagctatttaggaattgaggctgttactcctgacttccatgtgagactgccacagaactcatattgaaaatatgtcattttatccactaggttttgtttcctactttttaaattggtgttaagaaagggaaaaaaatcacaagtttgtctaactcagtagaaaaatcgacaaagcatttgcagacaacttggcaagggtacagagaaacggatgtactgtttttcagtattttgggagggtggtttgagcagcatttattgacaatttcattagtggggatgtttctattgaaaacagagttaggaagtcataaaatgttcttgcaatataaggtaataataccactggcgtttatcttactgttttcatgttctaagtgcatgcatctgagtaaaaggatctgggctgcagtccagtctgagagatgccagcaaaggcttcctaggccaattcagtccagtaaatccctcttcgatcttctcttccacacagacagcagtgatgagcatgcccatgaactcacatgattattttggggaaaatgaaagagttgtattctttttgaggtagtaattccactttcaggggcaaatacattttgattattttatcacccttcagtgagttgtttttgttctttaatcacggatgtatgtttgaagtaagaagtaaagcataaagtatatgattttgtgtgtgtgtgtgtttttatcttgctatacctgtagggaatgtttaattctgccttggaagtggccaaatttgaagatgctgtgattcgaactgtcagtgggataagggggcagatcaagagagcactctgagctccagaaggagctttccaggatagctttgaggataagctgcggatgagcggtgagtgtcttaagtagtgttcagggcagggtgttaccattcatgcttgacttctagccagtgtgacgagaggctggagtcaggtctccagagagttgagcagctccagccttagatctcccagtcttatgcagtgtgcccatttgccttgtgtctgcagtcccctggccacacccagtaacagttctttgatctatgagaatagtttccttagcgagctttcccttcaaatactttgcagtcaggtagagaagtttggagtgaagattttgttctttgtttcttcacaatatggatatgaatcttcttttgaaaacgttaaagtaaattacctcttttcagatattgtcttcatgcgaacttggtatcctgtttccatcccagccttctataacccagtaacatctttgttgaaaccagtgggtgagaaagacacctggtcaggaatgtggaccacgggccaactcaggctcgcccatggtgtcagactaaagacaaacaaggactctctgtataaggtactggtcgtgtgtgtgttagtggagatgaagcctgtgctctacagacagggagtcacacagacacttttctataatttcttacatactttgaatgttcaagtataaagtctaatgttaaatttgattgaacaattgtatatttgtgggatattttggaatggaacaccaaaaaatggtaatagtggttctttctggattgaaggaaaacttttcttttttaaaataaattttattttatatatttgaggttgacaacatgatcttaaaggatacatatagatagtaaactggttactatagtgaagcaaattaacatagctaccatctcacatagttagatttttgtttgtgtgacaggaacagctaaaatctacttatttaacaaaaatcccaaagacaatatatttttattaactattgccctcatgatgtacactagatctctaacttgttcatcctacatgtctgctactttgtattattttaatgtacatctccccatttcctattggtcatttcctatttggcccatttttcaactgggttgtttttctgctcttaagttgtaagagttctttactgatttttggatattaacactttatcagatatgtggtttgcaaatatttcttccagtctgtaggttcccctttcattttgttggttgttcctttgctgtgcagaagctttttagtttgatgcagtcctccttgtttatgtttacatttgtagcctggcttgtggtgcgatatccaaaaaattattgctaaggccaatgtcaagaggctttccccctatgttttcttctaggagttttatggtttcaggtcttatttgggtctttggtcttgtatctgttttgagttgatttttgtgtatggtgtatgatcagggtccaattttattcttttgcatgtgaaaatcctattattgaagagactatcttttttaccattgtgttgtcttgtttgcccttgtcaaaaattagttgacagtatatgtttggatttatttcaaaggtctctgttacgttccattggtctatttttttgtttttatgccagcaccatactgttttgattactatagctttgtaatgcaattttaaatcaagaggtgtgatgcctccaactttttctttcacagtgatctgttggctgtttggggttttttgtggttccatatgagtttcaggattgttttttcttttcttttcttttttttttttttttgaggtgaagtctcactctgtcacccaagctggagtgcagtggcataatctcggctcactaaaacctctgcctcctggattcaagcaattcttctgcctcagcctcccaggtagctgggactacaggcacatgccactatgcccggccaatttttgtagttttagtagagacagggtttcactatgttggccgggctggtctccaactcctgacctcatgatccacccgctgcagtctcccaaagtgctggaattacaggcgtgagccactgtgcctggccaggattgttttattctgttctgtgaagaatgtcatcagaactttgaggaggattgtgttaaatctgtatatttgctttgggtagtgtgaacattttaacaatattaattcttctgatccataaacataggatgtcttttcatttgttcatgtctaaatttctttcatcaatgttttatggtttttaagtgtacacatctctcaccttcttggttaaatttattcctaagtttttgtttttctttgatgctatcgtaaatgagattattttcttgattgcttcatcagctaggttatttgtatacagaaatgcaactgatttttatatgttgagtttataccttgcagcttaactgaattgatttagtagttctcacagttttttgtggactctttggagttttttacgtaaaggatcttgtcatctgcaaatagagataattttacttctttaatttagttgccttttttttctcatctgattgctcttgcaagtactctgttgaataaaagtgatgaggctggccatccctatcttgtactcaatcttagtggaaaagctttagttgttccccactaactatgattagactgtgggtttttcataaatggtgtttattatgttgaggaactttccttctatacataaactattaagaggttttatcaagaaatgttgctaaactttgttaaatgcttttactgcatcaattgaggtgaccatgtcattttatctttcattttgttaatgtgatgtatcacattgattgatttacatattttaaaccagccttgcatgccagggataaatcccacttaaacacgatgtataatgtttttgatgtgttgttgaattctatttgctaaaatttttttaggatgtttgcatcagtatttaatttattggagaagttgacctgtagtttttgttcggtgtgtgtgtgtgtgtgtgtgtgtgtgtgtgtgtgtgtgtgtgtgtgtgtgttttggtttggcttaggtattaaggtgatactggcctggtaaaatgtgtttggaattatttcctctcactctgtttttgcgaagagtttaagaagtaaactcccaggggatgggagtgactctggacatgggagtgacatgatagtgactctggaccctgcagtggtgggacacagcagcatctcagtctctgaaaggccaggcacagcatcagcaaggaccccagaatggtggagcactactgtggcttgagccctcgggggcagggaccagtacagcaactacttctctccctggggaggcaggtgcctgggcaactcagattctccagggctagtccagttccaaggaagcagggttctacagttgtttgtcctgaagggcaaggtaccccagttcagccaatgccgttttcctgggatatgggggtgccatgttggctcatccctggcaggtgtggctgctcagctcagccaagacactgattccctgtgaagcagggcagtgcttcagctctcatgcagtggggggtgtgactgcttagactggccaagacactgattccctggaaagcagggcaccaagtcagctcaggctccaaggggcagggcgcaatggcagctgggaggggaggggcacagcagcgtggccccgcaggtggggtgtatgctgtgatgtggacatcatttgttcccaccagccatttgaaatttcatccatttgaaatttgatttcaaatgtggtggtgtgggaggtggggcctagtgggagttatttgagtcacagggcagatcctttatgaatagattaatgccttttcatgggactggattagttaccaggagtggattgttatcagagtgagttcagcttcctagactcttgtgtttcctctcttgccatgtgagccccttgcatacacctgtttcgccttccactttccccatgagatgaagcagcacaagaccctcaccagttgtgctgcccgatctcggactttttagacacaagcagggtgagccaaataaaccttttttataaaataagttaccccgagtctcaagtattctgttacagccacactaaatggcctaagacagtgtaacagcggctcgggggtggtgggccactaggtgggtgtgatatagagcaacaaagcctgaggatggaagaagggtgcggtggctgctcaccctgggtgggacatgctcccgaagtggtccaggtccaggagggcacgttgcagcagcagctggtccatgggggtggggcacaatgtcagttccttctctgaggggagtgctggggctactgggcccctcttgcttccttattcctgcagggagacatcccctctgcttcaggctgatccctctgggggaatgggtggtgggggccagatgtttccttccctcctttatgtgaccgtcctgttttccgggctctactggatttctgctactccttgatgcactctggggctctcctttagtgactttcatcaaaatatagctgtttgctgctttggctgtctttgtcaggggatgagtgcaaggggctattgatcagcccttagctggcatcactccctcttaaacttttcactggatactcttttgaactgtttttttcccccaccatatacatgtattttttaaacgttaatgtgctaatttctactgaagcaatgtggatttttctgaaagctttaatgttttaataagctttttattgaaatgttaatgtacatacagaagagtgcccgaatcataagtgtgcatctagatgaactgtagcacaccaggctgccacgccctggaccaagcagtagccttgacctgtggcctctcccaggcactgctgccccaacccacaaaatagctactttcccagttcctgatgtagatttgttctgcctggttttgacttctataaaatacagcacattctatttagcctggcttctttggttcagtattacagaacacatccatgttcttgtctatggcagacattgatttatcgtcattgttgagttccattatatgactgtgtcaccatttttccattgatgagtaaaatgatttcctatttttggctgttatcccacggccctgaacagtaggtctgcatatgggacttgcaggtatgcaggggcacacccacttctgctggaggatccctgggtggggtggagactccagggcacctgtgctctgcttcagtgtggaggcttctgtgttgtgttctgggagcacagtggcttggcctccgccaccagcagcagcttgaagagttcctgctgttccacatggttgccaacaattggcctcttcagtttttttttttttttttaggttttcagtgcctgcctggacttgtgttttcatttagattttggtttcttagaactttcgttattctcttcacagcttaacaatgcatttgaaaagatttgttttcatgtggagtattcagttttgtaataggagggttgttcaaggcatcagtctgccactctgctagaaacagaattctcccaggcatttctttttatataaagtagttaatgaaattttgaaccatcttacatgaatttttattaaaatacacttcaggatgtggtgcccattatccattctactcttttgtaacaagtagatttctctgaattcttgaatttgaaaacaattggggttcctaaacagagaatatggaatattattggggatgatgtctttaataatacatctcaagataggagaaactttttctatatagttgactttaataaaagcctagggcaaaactttcaatatattaacagtatttatgaggcagttaagaatttgggtcatctctgtctccactaaaaatacaaaaagttagccaggtgtggtggcgggtgcctgtagtccctgctacttgggaggctgaggcaggagaatggtgtgaacccgggaggtggaggttgcagtgagccgagatcatgccactgcactttagcctgggcaacagagcgagactgcgtatcaaaaaaaaaaaaaaaaaaagaatttgggtcatctcaattaaacatagaatttaagattacattgaaaattcagtacagagtattttgccttcatctgttgtttgagtctcccttctttcagccatccttccatcagaaatagaataccaagttaaacttcttaattagaatcaggaatcaggactctttggctgctgattgaaggaagaactgtccttaaatccagagtgggccgggcatggtggctcatgcctgtaatcctagcactttgggaggccaaggcagatggatcacctgaggtcaggagttcaagagcagcatgaccaacatggtgaaaccccatctctactgaaaatacaaaaattagccgggcgtggtggtgtgtgcctatagtcccagatacttcggaggctgagataagagaattgcttgaacctgggaggtggaggttatgtgagccaagatcacgccactgcactctagcctgggtgacagggcgagactccatctcaaaaaaaaaaaaaaaaaatccagagtggttggtagtcaagacaaaaagctagattatttttgttagtctgggaactaaaaaaaatagttgtaactttgaagcctttttatggatcaacatgaagattgagggatctcaaacagaaagggcatcctggtggcaaaggttaatcattaccagactgcaagagtagtttcaatggcaagaaagcagcaacagaatcaatgaaaacaaagcaatgattagaatgccctttccccttctcctcctgacttgtagacactgattgtcttccttggacttagggaaccccttaggttcttgaaaaattcaatgatcaggctatagtagatggtccccagtacacagcacaagattttttgataaactggacattttgaaacccaaataactaattagaaaaatcaaacatgtgaaactactttatcccatgcataggggttatactggaaataaaatgtacaacattggaatcctgaaggagaaaagtcctaaaagtttcaatatcaagaatcctgcacctgctgctacttatctagccttttgcttgatttctggctgatgaacttgcacaactcttgaaaacttaaaaacttgaaaatttgtcacttgaaaactacttgaaccaaactatgaaatctcacctgatatataagatgcaattgttacaattattttaaacttcaatttactgttttgctctatcaaaagaaagtttcaactctgttagttgagtacacacatcgtaaacaagtttctgagaatgcttctgtctagtttttatgggaagatatttcctttttcaccttaggcctcaaagcgctccaaatgtccacttacagattctacaaaaggagtgtttcaaaactgctcaatcgaaattaaggttccactctgcgagatgaatgcacacatcacaaaaactttgtcagattgcttctgtctagttttgtgtgaagatatttccttttccaccacaggcctcaaagctctccaaatgtccacttgcagattctacaaaaggagtgtttcaaaactgctctatcgaaagttaagttcaactccatgagataaatggcaactccatgagataaatgacaaataagcttgtcagaatgcttctgcctagttttaatgtgaagatatttccttctccaccataggccgcaaagtgctccaaatgtccacttgcagattctacaaaatgagagttctcaaaactgctaaattaaaataaagtttcagctctgtgagaggaatgcacacatcacaaagcagtttcacagaatgcttccatctagttcttaaatgaagatacttccttttccaccataggccaaaaagcgctccaaatgtccacttgcagatattacaaaaagagcttttcaaaactgctcaatgtctgttcatgtccttcacccactttttgatggggttgtttgttcttttcttgtaaatttgtttgagttcattgtagattctggatattagccctttgtcagatgagtagcttgtgaaacttttctcccattttgttggttgcctgttcactctgatgatagtttcttttgctgtgcagaagccctttagtttaattagatcctatttgtcaatgttggcttttgttgccattgcttttggtgttttagacatgaagtccttgcccatgcctatgttctgaatggtaatgactcggttttcttctagggtttttatgcttttaagtcaaaagtttaagtctttaatccatcttgaattgatttttgtgtaaggtgtaaggaagggatccagtttcagctttgtacatatggctagccagttttcccagaaccatttattaaatagggaatcctttccccatttcttgtttttctcaggtttgtcaaagatcagatagttgtagatatgtggcattatttctgagggctctgttctgttccattgatctatatatctgttttggtaccagtaccatgctgttttggttactataaccttctagtatagtttgaagtcaggtagtgtgatgcctccagcgttgttcttttggcttaggattgacttggcgatgcgggctcttttttggttccatatgaactttaaagtatttttttccaattgtgtgaagaaagtcattggtagcttgatgggtatggcattgaatgtgtaaattaccttgggcagtatggccattttcacgatattgattcttcctacccaagagcatggaatgttcttccatttgtttgtatcctcttttatttccttgagcagtggtttgtagcacctccttgaagaggtccttcacatcccttgtaagttggattcctaggtattttattctctttgaagcaattgtgaatgggagttcactcatgatttggctctctgtttgtctgttgttggtgtataagaatgcttgtgatgtttgtacattgatttttaaggacatgaacagacatttctcaaaagaagacatttatgcagccaaaaaccacatgaaaaaatgctcaccatcactggccatcagataaatgcaaatcaaaaccacaatgagataccatctcacaccagttagaatggcaatcattaaaaagtcaggaaacaacacgtgctggagaggatgtggagaaataggaacacttttacactgtttgtgggactgtaaactagttcaaccactgtggaagtcagtgtggcaattcctcagggatctagaactagaaataccatttgacccagccatcccattactgggtatatacccaaaggactataaatcatgccgctataaagacacatgcacacgtatgtttattgcggcattattcacaatagcaaagacttggaaccaacccaaatgtccaacaatgatagactggattcagaaaatgtggcacatttacaccatggaatactatgcagccataaaaaatgatgagttcatgtcctttgtagggacatggatgaaattggaaatcatcattctcagcaaactatcgcaagaacaaaaaaccaaacactgcatattctcactcataggtgggaattgaacaatgagaacacatggacacaggaaggggaacatcacactctggggactgttgtggggtggggggaggggggagggatagcattgggagatattcctaatgctagatgacgagttagtgggtgcagtgcaccagcatggcacatgtatacatatgtaactaacctgcacattgtgctcatgtaccctaaaacttaaagtataataataataaataaataaataaaaactgctcaatgaaataaaggttcaactctgtgacatgaatgcacacatcaggaagaagtttctcagaatatttctgaatcatttttatgtgaagatatttccttttccaccattggcctcaaagcgctccaaatctgcacatgcagattctaaaaaaagagtgtttcaaagctgctcaatcaaaagaaaggttcaacactctgagatgaatgcacacgtcacaaagaagtttctcagaatgcttctgtctagtttttatgtgaagatatttccttttccaccattggcctcaaagcactccaaatgtcctcttgcatattctacaaaaagagtgtttcaaagctgctgaatcaaaagaaatgttcaactctgtgagatgaatgcacccatcacaaagaagtttctcagaatgcttctgtctagtttttatttgaagatatttccttttacaccataggcctcaaaacgctccaaatgtaaacatccagatcgtacaaaaaaagtttttccaaactgctccatcaaaataacggtttaactctgtgagatgaatgcacacatcacaaagaattttctctgaatgattctgtctagtttttacgtgaatatatttccttttccaccataggactctaagcgctccaaatgtccaattctagatgctacaaaaagagtgtttcaaagctgctgaatcaaaagaaaggttcaaatctgtgagatgaatgcatgcacacatcacaaagagtttctcaaaacacttctctctagtttttatatgaagatatttccttttcctccataggactctaagtactccaaatgtccaattctagacactacaaaaagagtgtttaaaaattgctcaatcgaaagtaagtttcaaccctgtgagatgaatgcacacatcacaaagaggtttttcagaatgtttctgtctagtttttatgtgaagatatttccttttccaccataggcctcaaagcgctccaaatgtccgcttgcagattctacgaaaagagtgtttcaaaactgctcaatcaaaagaaaggttcaactctgtgagatgaatgcacacatcacaaagaagtttctgagaatgcttctgtctagttcttaagtgaagatatttccttttccaccattggtcccaaagcactccaaatgtccacttccggattccacaaaaagagagtttccaaactactcaatcaaaaaaaggttcacctcagtgagatgaatgcacacatcacaaagaaatttgccagaatgcttctgtctagtctttatatgaagatatttccttttccaccataggccccaaagggctgcaaatgtccacttgcagatcctgcagaaagagtgtttcaaaactgctcaatcaaaagaaaggttcaactccgtgagatgaatgcacatttcacaaagaagtttctcagaattcttctgtcaggttcttaagtgtagatatttccttttccaacacaggactcaaagctctccaaatgtccccttgcagattctacaaaaagagtttccaaaccactctatcaaaagaaaatttcaacgctgtgagataaatgcacatatcacaaagaagattctcagaatgcttgggtctagttattatgtgaagatattaccttttcaacaataggcctcaaaatgctccaaatttccacatgcagattctacaaaaagagtgtttcaaagctgttcaatcaaaagaaagcttcaactctgtgagatgaatgctcacatcacaaagaaatttctcagaatgcttctgtccagtttttatgtgaagatatttccttttccagcataggcgtcaaaacgctccaaatgtccacttacagatcccacaaaaatagtgtttcaaaactgctcaatcaaaagaaaggttcacctctgtgagatgaatgcacacatcacaaataatattctcagaataattctgtctagtgtttatgtgcagatatttccttttccaccatagtcctcaaagcactccaaatgtccaattgcaaatcctacaaaaagagtgtttcaaaactgctcaatcgaaggtagggttcaactctgtgaggtgaattctcacatcaaaaaaagtctgtcagaatgcttctgtctagttttcatatgaagatgtttccttttccaccgtaggcctcaaagcactccaaatgtccacatgcgggttctataaaaagagtgtttccaaactgctcaagcaaaagaaatgttcaactctgtgatatgaaagcacacatcacaaagaagtttgtcagaatgcttctgtctagttttcatgtatagatgtttccttttccaccataggctgcaaagcgctccaaatgtctacttgcagattctacaaaaagattgtttcaaaactgctcaatgaaaagaaagtttcaactctgtgagatgaacgcacacatcacaaagaagtttctctgaatgcttctgtctagttcttaaatgaagatatttcctattccaccacaggactcaaagggctcctaatgtccacttgcagattctacaaaaagagtgtttaaacctgctcaatcaaaagaaatgttcaacccggtgagatgaatgcacacaacacaaaggattttctatgaatgattctgtctagtttttatgtgaacatatttccttttaagccataggcttcaaagcgcttcaaatgtacaattgcagattccacaaaaagagtttttcaaaactgctcaatggaaagaaaggttcaaatctgtgagaagaatgcacacataacaaagaagtttatcagaatgtttctgtatagtttttatgtgaaggtatttcgttttccaccataggcctcaaagagctccaaatgtccacatgcagattctacaaaaagagtgtttcaaagccgctcaatcaaaagaaaggttcaactctgtgagatgaatgcacaaatcacaaagaagtttgtcagaatgcttctgtctagtttttatgtgaagatatttccttttctaccataggctgcaaagcgcaccaaatgtccaaattcacattctacaaaaagagtctttcaaaactgttcaatcaaaagaaaggttcaactctgtgagatgaatccacacatctcagtgaagtttttcagaatgtttctgtatagtttttatgtgaagctatttccttttccaccattgcctcaaagcgccaaaaatgtccacttgcagatactacaaaaagagtgtttcaaagttgctcaatcaaaagaaagttgaaattctgtgagatgattgcatatattacatataagtttctcagaatgcttctgtctagttttgtgtgaagatatttccttttccaccacaggcctcaaagctctccaaatgtccacttgcagattctacaaaaagagtgtttcaaaactgctcaatcgaaagtaaggttcaactctttgagatgaatgcacccatcacaaataagcttgtcagaatgcttttgtctagtttgtatgtgaagatatttccttttccaccgtcggctgcaaagcactccaaatgtccacttgcaatttctagaaaaagagtttttcaaaaccgctcaattaaaataaagtttcagctctgtgagaggaatgcacacatcacaaagcagtttcacagaatgcttccgtctacttcttaaatgaagatatttccttttccaccataggcccaaatgcgctccaaatgtccacttgcagattctacaaaaagagagtttctaagctactcaatcaaaagaaaggttcaactctgtgagatgaatgcacacatcacaaagaagttactcagaatgcttctgtctacttcttaagtgaagatattaccttttccaccttaggccccaaagcactcctaatgtgctcttgcagatcctacaaaaagagaatttccaaactactcaaccaaaagaaaggttcaactctgttagatgaatgcacacatcacaaagtaattggtcagaatgcttctgtctagtttttatgtgaacatatttccttttcaaccataggcctcaaatcgcttcaaatgtacaattgcacattccacaaaaagagtttttcaaaactgctcaatgaacagaaaggttcaactctatgagatgaatgcacacatcactaagaagtttgtaagaatgtttctgtatagtttttatatgaagatatttccttttccactataggcctcaaagcgctccaaatgtccacatgcagattctacaaaaagagtgtttcaaagctgctcaatcagaagaaatgctcaaggctatgagatgaatgcatacatcacaaagaagtttctcagaattcttctgtctagtttttatgtgaagatatttccttttccactataggccacaaagttctccatatgtccacttgcagattctacaaaaagagtgtttccaaactgctcaatcaaaagaaaggttctactctgtgagatgaactcacacaccacaaagaaatttctgagaattcttccgtctagtttttatgtgaagatgtttccttttccaccataggcctcaaagagctcaaaatgtccagttgctgattctacaaaaagagagtttcaaaagtgctccatcacaggaaatgtttaactctgtgagatgtatgcacacatcaaaaagaagtttctcagattgcttctgtctagtttttatgtgaagatatctccatttccaccataggcctcaaagcactccaaatgtccacttgcagatagtacaaaaagggagtttcaaaacggctcaattaaaagtaaggttcaacactgtgaggtgaatacacatatcacaaagaagtttatcagaatgcttctgtctagtttttatgtgaagatatttccttctctgccattggcctcaatgcgctccaaatgtccacttgcagattctacaaaaagagagtttccaaactagaaaatcaaaagaaagtttcaactctgtgagatgaatgcactcatcacaaagaagtttctcacaatacttctgcatagttgttacatgaagatattttgttttccattacactcctcaaagcgctccaaatgtccacttgcagattctacaaaaaaagcatttcaaagctgctcaatcaaaagaaaggttcaactctgtgaaaagaatgcacacatcacaaagaagtttctcagaatgtttctgtctacttcttatgtgaagatatttccttttccaccataggcctcaaagtgatccaaatgtccacttgcagatccttcaaaaagatttccaaactagtcaatcaaaagaaagtttcaactctgtgagatgaatgcacatataacaaagacatttctaagaatccttctgtctagtttttatgtaaagatatatacttttacaccataggcatcaacgcactccaaatgtccacttgtacctagtacaaaaaggatgtttcaaacctgctcaatcaacagtaaggttcaactctgtcagatgaatgcacacatcacaaagtattttctcagaatgattctttgcagttcttaagtgaagatatttccttttccaccagaggcctcagagccctccaaatgtccacttgcagatactgcaaaaagagtgtttccaaactgttcaatcaaaagaaaggttcaaatctttgagatgaatatacacatcatgaagaagtttctcagaatgtttctgtccatgttttatgagcagatatttccttttccaccatagacctcaaagcacaccaagtgtccacttgtagattctacaaaaagagtgtttcaaaactgctcattgaaaagaaatgttcaactatgtgagatgaatgcacacaccacaaagaagtttctcagaatgttctgtctagttcttaagtgaagatatttccttttacaccataagcctcaaagtgctccaaatgtccactggcagattgtacaaaaacagtgtttcaaaactgctcaatggaaagaaaggttcaattctgtgagatgaatgcaaacaacacaaagaagtttgtcagcatgcttctgtctagtttttatgtgaagatatttcctttaccaccatatgccacaaagtgctccaaatgtccctttgcagattctacaaaaagagtgtttcaaactgctcaatcaaaagaaagttcaactctgtgagatgcatgcacacatcccaaaaaaatttcccagaataattctgtgtagtttttctgtgaagatatttccttttccaccgtaggcctcaaagaattccaaatgtccacttgcagattctaccaaaagagtgtttcaaaatagattaatgaaaagaaatgttcaactctgtgacatgaaagcacgcattccaaagaagtttgtgacaatgcttctgtctagtttttatgtgaagatatttccttttctgccataggcctcaaagtgctcctaatgtccacttgcagattctacaaaagagtgtttcaaagctgctcaatcaaaagaaagtttcaactccatgagatgaatgcacacatcacaaagaagtttctgagaatgctgctgtcttgttgttatgtgaagatatttccttttccataattggctgcaaagcgctccaaatgtccacttgcagattctacaaaaagagtgtttcaaaactgctcaatcaaaagaaaggttcaactctgtgagatgaatgcacacatcacaaagaagtttctcagaatgttctgtctagttcttaagtgaagatatttccttttccaccataggcctcaaagcactccaaatgtccacttgcagattgtacaaaaacagtgtttcaaaactgctcaatggaaagaaacgttcaattctgtgagatgaatgcaaacaacacaaagaagtttgtcagcatgcttctgtatagtttttatgtgaaaatatttccttttctaccataggcctcaaggcgctccaaaggtccacatgcagatcctacaaaaataatgtttcaaaggtgctcaatcaaaagaaatgttcaactctgtgagatgactgcacccatcacgaagaagtttctcagaatgcttctgtctagatcttaagtgaagatatttccttttccaccataggcctcaaagcgaacaaaatgtccgcttgcagattctacaaaaagagtgtttccaaactgctcaaccaaaagtaagattcaactctgtgggttgaatgaaaacatcacaaagaagtttctcaggatgcttctgtctagttcttatgtgaggatatttccttttccaccgtaggcctaaaagtgctccaaatatcaacttgcagattctacaaaaagtgggcttcaaaacttctcaatcaaaagtaaggttcaattccctgagatgaatgcacacatcacaaagaagtttgtcagaattcttctgtctaatatttaagtgaagatacttccttttccaccatatgccgcaaagcgctccaaatatccacttgcagattctacaaaaagagtgtttcaaaactgctcaatcaaaagaaagttcaactctgtgagatgaatgcccacatcacaaagaaatttctcagaatatttctgtctagcttctctatgaagatatttccttttccaccataggcctcaaagtgttccaaatgtccacttgcagattctacaaaaagagtgtttcaaagctgctcaatcaaaagaaatgttcaactctgtgagattaatgcatacatcacaaacaactttctcagaatgcttctgtctagttattatgtgaagatatttcatttttcaccttaggcctcaaatcactccaaatgtccacttgcagatgttacagaaagagtgattgaaaactacacaatcgaaggaaaggttcaactctctgagatgaatgcacacatcacaaagaatttgtcagaatgcttctgtctaatatttatgggaagatatttccttttccaccataggcctcaaagcgctcaaaatgtccacttgcagatgctacaaaaggagagcttccaaactattcactcaaaagaaatgatcaactctgtgagatgaatgcatacatcacaaagtaatttgtcagaatgcttctgtctaatttttatgtgaacatatttccttttccactgtaggtctcaagccacacaaaatgtccatttgcagatagtaccaaaagggtttttcagaactgcttaatcaaaagtaaggttcaactctgtgagatgaatgcacatatcgcaaataggtttgtcagaatgcttccacctagtttttttgtgaagatatatccttttccacctcaggcctcaaagagctccgcatgtccccttacagattctacaaaaagagtgtttccaaactgctcaatcaaaagaaatgttcaactctgtgagatgaatgcacacatcacaaagaagtttctcagaatgcttctgtgtagtttttaggtgaagatatttccctttccaccataggccccaaagcgctccaaatatccacttgcagatactacaaaaagtgtttttcaaaactgctgaatccaaagaaatgttcaactttgtgagatgaatgcacacatcagaaagaagttacacagactgcttctgtgttgtttttaggtgaagatatttcagtttccaccataggtcttgaagccctccaaatatccacttgctcattccacaaaaagtgtgcttcaaatctgctcaatcaaaagaaagtttcaattctgtgagatgaatgcacacatcacaaagtagtttctcagaatgcttctgtccagtttttatgtgaagatatttccttctccaccatagaccttaaggcgttccaaatatccacttgcagattttacaaaaagagtgtttcaaactgctcaatcaaaagaaaggttcaactctgtgtgttgaatgcacaaatcacaaagaagtttctcagaatgcttctgtgtagtttttatgtgaagatgtttccttttaccaccattggccacaaagcgctccaaatatccacttgcagattctacaaaaagtgtttcaaaactgctcaatcaaaagaaaggttcatctctgagacatgaatgcacacatcacaaaggagtttctcagaaggcttctgtctagtttttatgtgaagatatttctgtttccactataggccgcaaagcactccaaatatccacttgcagattctacaaaaagagattttccaaactcctcaatcaaaagaaagtttaaactctgtgagttgaatgcacacatcacaaagaagtttctcagaatgcttctgtctagtttttaattgaagatacttccttttccaccattgagctcaaagcactccaagtatccacttgcagattctacaaaaagagtgtttcaaaactgctcaatcaaaacaaagtttcaactctgtgagatgaatgcacacatcacagagaagtttctcagaatgcttctgtctagtatttatgtgaagatatttcctcttctacaataggtctcaaaccactccaaatatccacttgcaaatactacaaaaagattgtttcaaaactgctcaatcaaaagaaatcttcaactatgtgagttgaatgcacacatcacaaagaactttctcagaacgcttctgtgtagtttttatttgaagatatttccttttccaccacaggccccaaactgatccaaatatccacatgcagatccttcaaaagaagtgtttcaaaactgttcgatcaaaagaaaggttcaattctgtgagatgaatgcacacatcacaaagaagtttctcagaaggcatttgtgtagtttttatgtgaagatgtttccttttcctccataggcctcaaatcgctcccaatgtccacttgcagattctacaaaaagagtgtttcaaagctgctcaatcaaaagaaatgttcagctctgtgagatgaatgcacacatcacaaagaagtttctcagaatgcttctgtctagtttttaagagaagatatttccctttcctctagaggtcccaaagtcctccaactttgcagatactacaaaaagagtgtttcaaaactgctcaatcaaaagaatatttcaactctgtgagttgaatgcacacatcacaaagaagtttctcagaatgtttctgtctagtttttatgtgaagatatttccttttccaccataggccccaaagcactcaaaatatccacttgcagattctacaaaaacagtgtttcagaactgctcaatcaagagaaacattcaactctgtgagatgaatgcatagatcacagaggagtttctcaaaatgcttctgtctggttttgatgtgaagatatttacttttccaccatagaatgtaaagcgctccaaatatccacttgcagacactacaaaaagagtatttcaaaagtgctaaatcaaaagaaaagttcaactctgtgaggtgaatgcacacatcacaaagaagtttctcagaatgcttctttcttgtctttatgtgaagatatttccttttccattcagaacctcgtagcagtgttctgtaatcctgtgtgagggacaaacactcagaatccagccactgtgtactggaatcctatctgagggcacacatttaaaatccagatgtagtctccttgctttagtgaatacacttacctccttttcctgctatacatttaggcaaattatttttctgtatcttaaataaatggtaaatacctgaaatttcttactttttccaggcagagtgtcttcactatgtagctgtagaagtataactatttttgtctgtgtcacaattttgtactcaggaaccctggccatgtcactagccaaatggacataacttatggaatacatggacagcatccggttgatatgctctagagaaaaatagcagctaccatagacttcaggaaagacacatcgagccaatgacaaaaatgtgggtttcctaccttcagggagtctaagaatgcagtagaaagtgatgtggagcaaacatctttcaaatggaaggaagggatagggaaaggaagactgttagaggctcttttgaatgttagaggcaacataaaacatatttggatgtgtattctaaataaaatgcaaatgtcaagaaggatgtcagctgtgagtgggactcagagaaagagaaacgttttggactacagaggcctgcagtacaagtggatctacaattttgtttagggaatccaatgcctcaggtatctatgagaggcagaattttcctatggagccagcggcaaggctccagaggagaaatacagtacaagccactttattttggagtaaaagccttttgtacaaaaattacccgccccctccttttttgagaaacaatttcacattgggatactaataagaaggaatgctcagtcatgaataagggtgaccccgttgtgatctgagcattataggatcatagtaactacaaccagtcttccatcattccatggaaattgcatgtatgccacgttgccttctcagtttccaagggaccaattaatgaacaggctactcacattttcagcatcctactcctgacacactcccacccttctttctatttatctgtgattcatagagatttgcctatgactggattcctgaggagaaaaaagtctggattacagatggcattccttgttatggaaggcccttccttctgaaagtctatttctatcatgttctttccctgtgctgtcaaagggtcacccctttgtacaaaggagaagagaaatccatcaagtaaataaaatttcatttacctttgtaaaaaatatttctaccaattcacgtggaggaccttatggtttggtccgataatcagagatttgaaagaacctgatattgttggccagcagattagaaaagagttattagagagagatggctcaagtgataataactgtgtgccttgtgaatgctcacctaaaccaaagatcactgaagataatgtattttaccataatgttttaatctcaggtaaatgccaattaggagacaaacacttgtttatctcctgattggtattgatctgaattaagctgtctgccatttggagaaatttaaatgctattttaaacacacagtcttgttacttgagttatttatgatcttaagcggctcccccccttttgtgggttagattgtgtcttcaaaaagaaaatatatatattagagttctagcccctgatgtctgtgagtatgacttaatttgaaatcaaattatttgcagatgctgtataattatgatatgctagatgagctcataatgcattagagtgggccataattcaatatggttgatatcctcataagaagggaagaggaaacagagacgcagggaggagatggcaatgtgaggatggaggtagagaataaagtgaggtatcctccagccaagcaatgacaatgaagctcagtgatcacccggtgctagaagaagcaagaaaggatttttttccaggtcattcagagaaaaatgcagcactgctaactccttcatttaagatttctagctttctgaaccgtaaaagaataactttatctcattttaagcgacctaatgtgaaccactttgtcacagcagatataggaaattacacctccttaaagaatgcagaatcctggcccgtgcttgcctcatacctattgaatgagaatctaagggctctagaatctgcattttgaaactaatacataatacacaaagagaactcactaagtactctacatgcacttcatcctcacaagccatgaagtagtttactattataattctcattttacatatgggaaactggagcatgaaaagattaagtaatttgcctacagtcactcacataaccagaaagtggaagagctgggattcaatcccagttccagacatcctgatatcctggtttcagacaccacacacttagcaactattacacacttagcattattattattattattattattattattattattattattttaatcaccatctccaccttcttaagcactcaaaagttgaaatccagtggtgtgttgctgtttccattcatagcaagttatagccaaaatcataaattacacttcctccaaaacagtatactgacttctcatctctttttaaaatcccttccgtcgttcttttctttcttctcttctcttttcttttctcttttctttctcttgctctgtcacccaggctggagtgcagtggcatcatctcggctcactgcgacctccacctcctgggttcaagcgattctcctgtctcagcctcccaagtagctaggattacaggtgcccaacaccatgcccgtttaatttttgtatttttagtagagatggggtttcacatcttggccaggctggtcttgaactgctgacgtcgtgatccatccacctcggcctcccaaagtgctgggattacaggcatgagccactgtgcccagcctctttcacccattgaaatctcatttcaacaattaccatcttttttgagtggtatttttgaagttataaatgaattccctataatacatagtgagaatatttatgggagcttcctaattgactttctaaacattctgcattgcttctcatttccttctttaaatttccttctaccttgacttccttaagaccactcaatgttggccccatgctttcatttttttcttttttcttttttttttttttttgagatgaagtttccctcttttcacccaggctggagtgcaacagtgtgatctcagctcactgcaacctccgcctcccagtttcaagagactctcctgcctcagcctcccgagtagctgcgattacaagcatgtgccaccatgcccagctaattttgtatttttactagagatggggtttcttcatgttggtcaggctggtctcaaactcccaacctcaggtgatccgcccgcctcggcctcccaaagtgccgggattataggcatgagccacaatgcccagcccatgctttctttttaataactccttgctgcctagttttttcatgtccactgtgtaactactagtcttaatgggtatttcttttcttactattctgcaccaatgtttccctgattgacaacagttttcctgaaatgtattcttggaatggaattgtatgatacgcttagaaaattctgcataccttatacttcagaatgtgtatgtaaaagactccagtaaatgatccagggaagcaaaaatatttgtgtgttttgcgagttgtattcatatgtgtataaaattcccacagcactttgggtaacaatgctctgcacacttttcctgtgctccttttatccattcccacacttccagcatttcctttgacgtttgattttctttatttttttttactccaatattttcctgtaggtttcaaacctgtattttaaaatatcaactgattctctccctctgtcttcaccacctgcatctcaaatttgacatagccataaacacattttatattttggcaaataaatctatttcttttaaagcattgcccatctcagctaatgatgataatatcaagccagtcgccaagaaaatttagagtatttataccttgactcttccttctaaatgaattattaagttcagctgtttctaccttgaattacctttctattctgccatttctcttctgtgttgctgctaatgttttaatttagttattcatcacatcatgcctgtactgctggaataatcttgactattctttctgactttttcttctaactgcatctcaaaaacttctatctagaatgaaaataagtatatatatatatactatatatacatatatacatatacactatatgtatgtatatagtataagtatagacatgctatatactatatatactatatatttatatacacacacacccactatgcttttaaaaattgtttacttatgtcccatcattgaagggtaaaatacaaaatcactgatattgagagacattctcctcaatcatttaacattttccttcacaaacctgtgctgtagccacacccagaacaggttatgttccttcaaagacacacacacttttctatcactctccttttactccttctattccatctgcttagaccattttttacttgttttctgtctatctccattcatttttcaggatccaattaaaatattgatacaaaggctgagatctttatatcttctcttatttaaattcctggaacaccagataacttcctctattataattcttactgtatacaaccataactctcatttgaaaacaatgaatacataattataaaatcagatatatcataaaatgattggtatcaatatgtgaaaaaaaatctttaatgttgaaagtacaagattacaagccatctgaaagtaactgaacatcaatcagagaaaaatgctcatcattttttgatgaaaccaaaagtaagagaatttggtattaatctactacatcattggtaaattacatattaattattgtgagaaagaaataattgacggaatttaaagaaaatcggttttcctttatttttattattctacctaaaaatattatatctaattaaaatcatgattttaaaattatcccatcaagtatgtcatcacactaaaatccattgtatttaatttctcaactgagaaattgtattcaattgtattcattttccctactgaaaaattaatataaaagcaatcacatagcattcagaaattaataaatatttaaagaaattaaacagcattagattttcttgttgtaaaatttttttcttctctcagtatggcttatgtctctgcttctattgaacatagcacaattcaagtattaatacagcacctttataaaagttgtgaatctcagaaatgaacaagcttacctccttagttatttattaaaagttacaagtcacttttttttaacttcctaataatcttagaggggtatattttgtgtttttgtttgctatatctttcataaagaagatccctaatgatttgaaagttagaaccaattttctgaaggattgagccacgctccttgaagttgtgtgtttgtgggtggcacactatgtcttttgcagacccggaacctaccccttgatctagaacatattttcctccacctgccttttaagtttttatttcagcaggagtgggtggtttgtggttgaccgaaaatagaacgggctacaaaagcccttcctgtttgatattgaatctgctatttgagtcacccttacattatgaactgactgttaattaacacatttggtaagagaatatcctgatctgctttgcatgtgaggctctcccagtaataaacaaagaagcataatcaaacaagattttaatttctctatgccctgttagaaattcagatataattcaagtcatcttggaaattttaagttgcattctgatgtcgtctctgttctggccattgtgcaatgggccttcaaatgttgtagtagaggccaactgatattccattgttattcatttatacacaggtacatatatggtgtgtgtacgcaaatatataaatattcatatatgtgtacatgtgtacatacatacatatggaggtaatacaagtttgcattgtttttaaaattattttacccaaattaacaatgactctattgcatatctttattggttatatcacatttatataaataaatttatatcagtgacaatttccaagtaagtgaaatttgaattggattcagggttttatttttttgaaatttctgattaaaattacttgattttttaaattttatcttaaaatattcaagtcccatttgtaaaaaaaaaatagaggattaaaatgaagtgtgtctttatgagtcacaaatttttattttactttactaattgttaaaataatattttttccatgaggcattttataatgccctctttatttttttggtgatgtatttttttattattattattatactttaagttttagggtacatgtgcacaatgtgcaggttagttacatatgtatacatgtgccatgctggtgcactgcacccactaactcgtcatctagcattaggaatatctcccaatgctatccctcccccctccccccaccccacaacagtccccagagtgtgatgttccccttcctgtgtccatgtgttctcattgttcaattcccacctatgagtgagaatatgcggtgtttggttttttgttcttgcgatagtttgctgagaatgatgatttccaatttcatccatgtccctacaaaggacatgaactcatcattttttatggctgcatagtattccatggtgtaaatgtgccacattttctgaatccagtctatcattgttggacatttgggttggttccaagtctttgctattgtgaataatgccacaataaacatacgtatgcatgtgtctttatagcggcatgatttatagtcctttgggcatatagccagtaatgggatggctgggtcaaagggtatttctagttctagatccctgaggaattgccacactgacttccacagtggttgaactagtttacagtcccaccaacagtgtaaaagtgttcctatttctccacatcctctccagtacctgttgtttcctgactttttaatgattgccattctaactggtgtgagatggtatctcattgtggttttgatttgcatttatctgatggccagtgatggtgagcattttttcatgtgttttttggctgcataaatgtcttcttttgagaagtgtctgttcatgtccttcgcccactttttgatggggttgtttgtttttttcttgtcaatttgtttgagttcattgtagattctagatattagtcctttgtcagatgagtaggttgtgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggttgaacttttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcgttatttctgagggctctgttctgttccattgatctatatctctgttttggtacctgtaccatgctgttttggttactgtagccttgtagtatagtttgaagtcaggtagtgtgatgcctccagcgttgttgttttggcttaggattgacttggtgatgtgggctcttttttggttccatatgaactttaaagtagttttttccaattctgtgaagaaagtcattggtagcttgatgggtatggcattgaatgtgtaaattaccttgggcagtatggcctttttcacgagattgattcttcctacccatgagcatggaatgttcttccatttgtttgtatcctcttttatttccttgagcagtggtttgcagttctgcttgaagaggtccttcacatcccttgtaagttggattcctaggtattttattctctttgaagcaattgtgaatgggaattcactcatgatttggctctctgtttgtttgttgttggtgtataagaatgcttgtgatttttgtacattgattttgtatcctgagactttgctgaagttgctcatcagcttaaggagattttgggctgagacaatgggattttctagatatacaatcatgtcttctgcaaacagggacaatttgacttcctcttttcctaattgaataccctttatttccttctcctgcctgattgccctggccagaacttccattactatgttgaataagagtggtaagagaggacatccctgtcttgtgccagttttcaaagggaatgcttccagtttttgcccattcagtatgatattggctgtgggtttgtcatagatagctcttattattttgaaatatgtcccatcaatacctaacttattgagagtttttagcatgaagggttgttgaattttctcaaaggccttttctgcatccattgagataatcatgtggtttttgtctttggttctgtttatatgctggattacatttattgatttgcatatattgaaccagccttgcatcccagggatgaagcccacttgatcatggtggataagctttttgatgtgctgctggattcgttttgccagtattttattgaggatttttgcatcaatgttcatcaatgaaaatcaatatatatcataacagctctgtaaatgtttctctgagttctgtgagccatcctaggaacttaattgaacccagggagggggctcatgcgaaccctttttttttttttttttttttttgagatggggtctcattctgtctcccaggctggagtgcagttgcaggatctcaactcactgcaacctctgcctcccaggttcaagcgattctcctgccttagcctccctggtagctgggcttataggagcccgccaccacacccagctaatttttgtattttatttcatttatttatttttttgagatggagcatcgctctctcacccaggctggagtgcagtgacatgatctctgctcactgcaagctccacctcatgggttcaggccattctcctgcctcagccttccaagtagctgggactacaggcgtccgccaccatgcctggctaatttttatttgtatttttagtagagatggggtttcaccgtgttagccaggatggtcttgatctgacctcgtgatccgcctgccccggcctcccaaagtgctgggattactggtgtgagccaccgtgcccagtttaatttttgtatttttaatagagacggggtttcaccatgttggccaggctggtctcaaacccctgatctcaagtgatccacccgccttggtctcccaaagtgctgggattacaggcgtgaaccaccatgaccggccgtggatgtagtttttagccaggcagtcagaagtatgcgtcgcctggacttggaattagtgcctgaagtggggctggtctcatgggatcgagccgtcaatctgtgggattggacactatctgcaggtagacagtgtcaggattgaattgaataagaggacacccagttggtctctgtgagaaatgtttggtgtgtaaggaaaagcccccacacagccagccacagaagtgtgctattgttgagtgtgagagtacaagggaaaaacagtttgcttttttgctttacagtgggatatttgatccataggtctatatctaagcacatgaatagaatgtgtttgggcctggttttttagtcttgctggtcagtaactagtttgacaagagagactagcacactgatcccaaaagaactaggccaagagcagataggatttgtggaaacttgaacctcttattagctccttaaaagacgtacttttctagacttctttggagcctgggattctagtactggtgagtttccaccggcagcagactccctgaagatttgctagccctctgcagggttggcaggccactaccacatttagttggctcctagggtatgttccacaccagacttcccattgtgggaaggccaagagaactgaagagacagtctctactctggaggtggggaagtgggggaggtggtaatttaattaacagtaggtggtgggtgaggcgacttggtaaggtaagaggacacacaaaggaagtaactgcagtaaaccttagctggcagcacaagtgaggaggtgtgcttgaaagagaaatggagtgtctggaagtgggtgagtatattctggtaggtgtgacaaaggcactgttcctccaacaccagtcctgggaaaggcatatgatatggtttggcgctgtgtccccagccaaatctcatgatgaattatgagcttcagtgttggaggaggggcctggtgggaggtgactggatcatgggggtgaatttcccccttgttgttctcgtgctagtgagttctgagatctggttgtttaaaagtgtgtggcactgccccttcactctctctcctgccgccatgtgaatatgtacttgcttcccctttgccttccccatgattgtaagtttcctgaggcctccccagccatgcctcttgtatagcctgcaaaactgagtcaattaaaccttgtttctttataaactatccactctcaagtagttctttacagcagtgtgagaacagactaatacaacatgggatcccaagtaactatgcattcagagaagaaacacaggtatgtttgggaactggatgatggaaggtacagggaagcactgtaggtaactttcatgggtcctacactctacaacatattcttggggttggaatgagtcaaacaggagactgatgtccaggatggaattggctgtttatgttcccaggtgtaggtctcttccttaacagatcacggtagcttcattacaaatggcctgggaagcgtacataatgcagaaaccccagcaaattcttacaggggttagtcatgcagttatacattttcattctgggatttctaggggcttaataaaattccttcattggatcatttaatccaacataaattatttccctacacctactttatacttgctccctgatttcataccagtgagtatagcctgatgtaactaaacattctgaattttcagtgatacccagagaagagtgtgataaccaattctctcaaaagcgatttactgcaaatattttcatttacagtaagtccttacttaacattgtggatatgttcttggaaacagtgactttaagccaaacgaggtactgtgtggcttcataactcaactctttttcctatcaattagactatgggaaaactggtttcgtatgcattatgtccttttgcttaaagtggtagtttccaagaacctatcaatgacattaagtgaggacttattgtaatctgatatctgcgggtggataatttaaggaacacatgcatagttaagcctgtaaactgctgcaagttccagatattatcagttctatttctccacaattacaattccagttttggggtttctttttgctcattaaatttgaaaagccaattccagttttaaagcttgacccttttcttataactttttttataactgataatatatcagttatatcagttatatttcttaggcttcccacgaaaccctcaaactgactctgagggtggccttgctatctaatttacaaaaccggttatcttggtttgtgttcattttatttcccttgcatacattgcttagctgcttctgattatatgcctcttagccgcggctggatagaaaagtgtaataagagaaaagtgtaactaagagacacagaagaaagagaaattccatgagcaccagatacttttatgggtgccttttggaagctctaaattgagatgtatctttgttgtcaatttatgctatgaatccaaacgaaaaatggggggagaaaaacaaataggctgtagatgaaagtggaagaagaaaaatgagtctatatatatatatatattagcagttgtatgaaagtatatgagtcaatattccatcaatacctagaaaaatagtagatcaatatgctgattttaggggtggacacaaaagtgttataagtgtcttttaacttttcttttttccctccttgactctgaagagaaacaccattttttctacgtatgcaaagagtaaaaattcagaactaacatgcagggattaatagcagtgaattgcaaactcaactcagtggtatagtacctggcaacattattactcagcatatttccctggctgaggctgacttcatttaaagtagttttatacttgtgctaaaaataagtgtacatcccattaagggagaaaagatcttctacacaatggattggacctacataaccttatgtaccagagaagaaaacatcattctcatgagtcgcaaagctttcttcttcttgtcaatatgataaacagtttccgtaaattgagaatgacgctggttactttccttcctcctgaacatgccacactgaagagacagggatgactccttccctatgggacagacacacatgtagctttccctgggttgtggaggaaggcatggccacaacaccattggcagtctgctgcagggacctcacgatgagaggaagcaatggatgcctgggccagggaaatgcatatttgggagaaagcaggaaattctgatgtagagatagggaagaaccctggggaaaaggacccaagctgggcggggaggaggaaaccaccaggatcccaggatcagagacaaaggacccagggacacaaacaaagtgaggccagatggagagggcaggctcacggggagagcaagctcacagggagagcatgagccaaacctggcttatttcacactcatcagagagactgcacagatggggccaaaccagggcccaggagcatcggagagaggagggccatttcaaagacttttgtaaaataagctcaaagtttctttgtttatttgtgggtgtgggagtggaaacgtagggaaagtgaagaaagtgggggaaaagggatgggtgattttgtaggcaagatgctccctgaggaggtcctggtggacctgctgtggggcgtggcattctgcacactctcatatcatggggagcgcatgactacattactgcttacacatctccaagtgcagcttggggggtgaatgtttaattgtctcactgtaactgtctaaatctctggaaaatgtgaagggtcatgcatttgatttaaacctatgaggtctgaatgaattctcctccatgcctaaccgagtgaagcaagtatataaccaaccatgcatccctaagcagggccggtatgaaagggaggaaacgcctccccactgagctcgcaaagaacttcatcactgacctgaatcagatccagcaggaaatgaaacactgagtacatacttttacagtagagggagggggacggaaaacaaagtgagctgaactgaaacgtgagaaagaacagaatggcagtgagtccacggggcagggccgcagctttcttttttcatggccctcagtccagtaaccccacccggcattcgtagcggatgacatcattgatgcccaaacatgctccagcaatttcctgctttccagagtccagccgagccatgatgtcagtggtgcacctgggtaaagatatggcagggccgggtcacagggagtggggacaaaggccaacccagttaaataaactgctggtcttctagggcctggtccctaggcaggcttccaccatgagataggtatagcccaggccaatcccaacaagaggaaaaaaagcatgtacttggccgggggcggtggctcacacctgtaatcccagcacgttgggaggttgaggcgggtgaatcacgaggtcaggagtttgagaccagcctgaacaatgtggtgaaaccccgtctctactaaaattggaaaaaattagctgggcgtagtggtggccacctgtaatcccagctactcgggaagctgaggcaggagaatcgcttgaacctgggagatggaggttgcagtgagccgagatcacaccactgcactccagcccaggcaacagagtaagactctgtctcaaaaaaaaaaaaaaaaaaaaaagaatgcacccatgcagtgcctcctgtcaccctctgcccagaaagggcacaggggccagggtgaaagagttacaggaagacagagggaaggaaaccatgcagacataaccacatgggggcaggccctaagctgctgggacctccacagtgtatccctttcctccaactgggagacggaagcaccgatggtctttctctacagtgccaggagccaccctgcccccagagatgccctacaatcaatgactaccatctaaatgcttctggatagtttcattccttgtagatgatattccaaatattataatttgtacttctccacaattacaattccagttttggggtttctttttactcattaaatttgaaaagccaattccagttttaaagcttgacccttttcttaaaagtttaacttctctttttattcaggcttcccactaaaccctcaaactgactctgagggtggcctgactaatttacaaaaccggccaggctgcctaacccctagattccagcccagagtgttgccataaattgctgtcaagacatgcctctatgtcccatgtttgccagtgagaaaagggttcatattctaagttcttcaagtctctctcactgcctcaatgtgaagtcaatggaaaacagtcaaatacaccaaaaattaacttcaaatggatatctgctatgaattccaacttggttggacacctctccaggccaactgttgtgaaaatgcattgttgttttaaaaaacactgtgagagatggctgggcgtggtggcttacttgaggtcaggagtttgagaacagcccggccaatatggtgagaccccagtctctatgaaaaatataaaaattgagccagatgtggtggcatgcacttgtagtccacgctacttgggaggctgaggtaggagtatcacttgaacctggaaggcggaggttgcagtgagccgagatcatgctactgcactccagcctgggtgacagagcaatactctgtctcaaaaaaaaaaaaaaaaaaaaaaaaaaaaaaaagagagagcgagagaaaacactgtgagaagaaagaagtcaatcaccccctctccaatgcccaacacagtaagcaagaagggcccaggaaaaaattaacagggaaaaacaatcttgcatttgcttagtggaatctggggtttgcacacattagtcagagctagacaaatcatactgaatacacttcttatagaaacattctagctcttatggcctttccttgctgtcccaacttttgaggtgcgaaaacacagcaacacagccaggaccggccaggtgatggcacggagcccgctcccacaggctgcgtgtgtgttctcactctcttgcaactggcctgagttaagccttctccccaagcacttgcagtttatcatcgccctatttactgtattttcatgttataaaagtgatatacacccaacgtagtaatttgatctatacaaaaaagagaagaaaaaaagctactcataatatcactgtctaatttaaggttttggtgtagtctttctagtctttttctatatggaatgtaatttacttctcaaaaatatcatttcatattctttgcttacatattagcatttttgtcatgaaatttatgccaactgattaaacagcccttgtaaattacagaaacttaaagacaatatcaaaacaatgtgaccacaagacaaagaccacctactactaaattatttttggcatgagattattttttgagaagttttataaactattaggtttattgaacactataaactgtaatccttgaaagaattttggaagcatacgataacagggtaatttgtagtagaatatagggttggaaaaccttaaaaaacacttgctcatttcttcctatatcaaagatttgtattagaaaatctatttcttacaaaaagatgtactaagtggtattatgtcagtcaagcatcttgtattattttctagctttcaataatatgtataatgtcataaaaaagagggaagaatacacaaaatacatatgaagcttactaggaatgaagaaagttattttaggaaggaaaaattggttaccatcaaggaatatggaaaacactagcaatgcatgtaagaatgacctcaaaggtcttagacgtccacgagctgggaatgcttgtgctgggtgcttcagttacaacagcatggggaagttaaatagactagtgaagctgttacatcagttaatagtatttattattatttgtggtcaccaatgccaattaaaacaataattaaatagaacatgatgaaataattcaatggtaggaaaaaaaaatctggcctacaagtgaacatggaaagtaaaagtaaatatttagaaagtgaaatcaggagtggaaaaaagctccagcatctcaccatggggtcttccaaagccagcagtactggagatgtttattgttcaaagatggacttgcttgggttgggattctccaactagagccagaggggagattctctgcttcccttgaggacacaaaaagagaggctttcttataaagcctgccacattctgtgcctgtattgttttatttactggagtctatcataaggcctgtgaggaaaggactgaatctctttctcatagccgttgggctgatggccctgcgtgctgtaggcatttaataattcactgagtaaatgaatgaaccctgcaggagattgggagcctttctgatcttgaggtctcagtttggactatctttctggaatggatagacgaatatgtttttcagcagcactctaataagcgcacattgggtgactaagcagaagagtgattcgttttgctagaattttccaacctgcaggagccagtccccctggtgtccccattccctgtcccctcagtcatctcagcaggaaattactatcctttctcccacatgggtgatgaatgttcaaggcatttcagcacactgtggtaaggcccagaatgggttcaagtaaaagtaaataccagtccttattaggagatcctggcccctctgctgcatgtgtcccagtacacatgcagcttcctgctctgtcatagaaagcagccctctagggccactgcctccagtgagagtttcctgacctccaggaacttctgtagtcaggcaccactcccttccctcacacccaacaccctgttgttccagattttatcactgtgcactgatgctcactgcgaccccacatgtggccacaggaggaactcggctgagggctgagaagaccagataatgacacagagggctcacttcaggaaacccagagagctgcagcggctcctccagggccattccacgcattcattttctaacaagtcataagtcaaagagtgacatcaggagcggacagcctggtgtccaggcatgagccatggcaacagattctgatttcccagaacggctttggtctttacctggtgttggatatggtagtgttagctggagtgggaggagattcacattgtatatttgtttagtgactccaaagattttaaattatattgtgttttttattattttattccatttttttagagacagaggtctcactctatctcccaggctggagtgcaatgatatgatcataggtcagtgtagcctcaaactcctgggctcaagtaatcctcccatttcagcctcctgagtagctgggactccaggtgtgtaccatgactcctggctaattttggtttaagtagagatacagtctggctatgttgcccaggctggtcttgaactcctggcctgaagcaatccttctaccttggcttccaaaagtgcttggattgtaagtgtgaaccactgtgtgggccctggtttttgtttaatggctattaaatgctcagaagtgaattaaggttgcagttaaatgcacaatttttatatcaaactattttctttgctaattcacttctatctgcgtctaccagctgtaaactacctgaagcagagaaagtttctttaggttggggcttcctgtagccccgagctgagtgtcttatgcagcattggccgagtgaatgaatttgttgggtgaactgctgcggggtttagagtccgcagagggtaggacaggacagatcgtgatagaggctaaccttctcatctactctaccatttcatgctctgtttgggcacctccatcacccctcacttcccctgatggtccagtctctctgggcctgcactgtccagccaccctcttatccctaagccaaggcctttgccaactaaagctcaggagtaaagtggccatcactgaggccattctatgtatgtatgtatgtatgtatttagagatggagtcttgctctgtcacccgggctgaagcacaatggtgcagtcttggcttactgcaacctctgcctcccaggttcaagcaattctcctgcctcagcctcccaagtagctgggattataggtgtccgccaccatgcccagcaaatttttgtatttttagtagagatggggtttcacccttttggccaggcaggtctcaaactcctgaccttgtgatccccccaccttggcctcccaaagtgctgggattacaggcatgagccactgcacccggctgactgaggccattctaaggaatatacagcaagctcttcagtacccatttttgttaactgaggtataactaaatgatacacaggcccagcacagtggcacaaacctatagtcacagcaacttgggaagctgaggtgggaggattgcttgagatcaggagtttgagtccagcctgggcaacacacgtgtataggtctatgagtctggaagaatgtatatagccatggaatcactaccatgtcaaaacataggatatttccattatcccaaaaagttccctcctgcccctctgcagtcaaacacttccctcccccaactcctggcaactgctgatctgaactgtagacctgaaaatgtcattcagaacccatttcatctggacccttctctctgtgtcaacattgctgtgagcggtgtctgtgggatttttctggacgttctctgccatgcccctgctccttccttcctgccttctggaaggcacccctgccaggagtcggctgcattaaagtgggtgtttcaggggtgtcttcctttactctcttctcactgatttccagctatccctgtgtctcttgtttaatgagtgccttcacccatatccttaaacccaccagggcgaccttcctgcccctttctttggagagctgtatctgtatttccagtggagacacagactgttccttagatcctattaaccctctgagctctctctcttcaagccaggctcatttctggcttggccaatctgcctcctcccgtgtcctttccatgacacggtgatggcatcaccagccagtcaccaagctagaacagtcccttcacccggcccctactgtaggaggatacttttagagtatgtctgcaattcacccccactctctgtatctacttctgtggccaaagtgcggaccttgatttcctctggccccagctgaattaacccacctctctgggcctggttctcttttcactaaacattctccacattgctgccagagctatttttctaaaatacacatcagaccacattcttctcctccttctttaaaaacaaaaaatcaaaaaaataaaaaaccaagaaacaaacaaaaaacccaccctaccgtggctcctcagtgtgtagagatcagattcaagttccgtgagatggtcttcaagatccttggccatgtgaccccgtcctgctatcccaatcccattcccattcccatccccagcctccccacctcatccaactccagccacattggatcaccccaggagaggatgtcatgtattagtactctggtgcctttgagtcaaaactcactgttttgccagttcagaggttgagccctttttgaagaatcccctcttcttccacagcccaggtaagttctaccccaggcataatgagctgttatccccctgggatctgagggcattcagaataccaacacaatgctctccagatacctctatgctattcaaatccatgcatctcacacctgctcatcttaaaatctctgtgcctcacatgcaggaagaattcaaatgatgctgattgaaaaaacattgtgtccaatattagatgaagcatgtaaatatcaaggcaagaatctgcactttttgtctgtctattgcttgtttgcacaatagagccacatggtttattataaaaaattattataatgtatgctgtttaagctcagatcactttgcactaatgatgatgataatgatgggttagaattttttttcttttcttgccatgggatctgccaggttttaagaattcttttttattctaaaccaaattcaggagcactcccaaagacaagaaatcaaatttaggccactgatggtaccaacggaaggctatcactgtgtagctataccaaatgaagccaatcttcatggattttaagcactttgataagcttttatatctctgctcatctcgtttacctccatagataacacaaaataacagaataatcaaccaatagcaacgtaatcccatcacaacaacatcaaaaatgagaattcatatgattcagtaatttcctaagccagaacttcccacctgatgtgctggggaagtgagagggtgaggactgctttccccagcccttagggtgactgggcagatcctgtctggtgtgagcattcaaccctactgattacatcattttgggtgctatgtgtgataaaggttgacaaccactgtcctaagccattctaccatttaaatagactgaattctcccaagttatgttcttacttgccttaggaaggaaattagtattatgactctaaggatcctgaacacatgatctaaaaaaagaaaaacccaaagcacaatggcaaaggtaggtgagacagagtgtttagaaaaatagcgaatactgtactattaattactcccaattctccctaatccatgatttttaaagagcgggtggagcataacgatttgaggcactgcgacaatgcagaatggggagggattttggaaaatgtgactcactcaccgttccgaccaaagggtaaatgaacccagcacctatgctggcccggacatcactgataggtaagatgaagtcccttggcacaccttttttgtcaggttggtgagacagagaaagatcggtctttgccatgcagatgggcaaatttccaaaaccctgtaagaaaggaaagaaaatgtgttcactgatatagacgtgagtctcctgtgtttttcaatttgcactttatacagtctcggcagcaatggtatgccagctcagatcgaggcacacgcaggagctgcttgttactacttgttcactgaagaagcaagaaggtgaggataaaaactcatctccatgtgatgactgtttagtaggtcaggggtgactattgtttattttggaggttctcgttaagagaaggcagtgttatgtgcatgtttgggaaaagcattgctatttgcaggcaaagcagcagctgtagaaaccgctttccaagactattaatatccgggacccagcaaggtagtctggagaaaggctctgcgactaggctcttagtcatgttgttcactcattctggagtcagtcaagaagcaaagggttcctttgtgttggtttatgaatcatggttatttgatctgcaactacattacaagagctaagatgaggtcactatttaagcttcttgtttttaaggacaaaagtctatgtctgacccagagttccaaaggtgaaagagcaggaagtcacatgtggtgtctcacaaaaagcacagtgtcctataagcctgtttctgattaaatggcacacagtgttccttcagaggctttgctaattcattgcaaccacatacttggcactaactttaaaaaaaataaaaatagagatggaggttttgctatgttgctcagagtggtctcaactcctggcttcaactgatcctctgccttgcccccacaaagtgctgggattacaggtgtgagcaccgtgcctggttgacacgacttttaaggagtatttccttgatagagataaagggaatgaaatctttagtcaaattttcataagacttagcctaaaactatttggaagatcttagagtcttatcaacttagggaggacttgggcttggggccattttctttttgaaatctccactcttctatactgataagaattttgctgagtgagaatcacaactgcctttcagaatggtgccagaattttgaatttcagacatggttaaatattaaagtaatttctataggtttgctaatgtaaaaattttgttagtaggcatattaaaaagaaacagaaaccaaccagtatgctatatactgtcaccagattacttcataaaagaaataacattttaacactgaaaggagaaaagacttaatattacaataaatgatagtcttaaatatcattattaaaaactcggggaataaaaaacaaagcaacctcatgagaatgaccttattttacttggttcattgcacatgaatgaaaacttcaccacaatgcctaggcacagagcagtgcttgggaatcctttttgtaaagggtaagccaagaacatcagggaaaattctaagaatttagaactttctgagttcctattttaccaaacctaggagaacaaataccctggctggcaatggtagcatttaacaaaatttcaaatgggtttacaaaaaagaataaggagttggagattgtttttaaagataaggtcaacactaccaatcatgaagctctttagccaacaggctcttaaaatgttctgacttctatctatctgattacaccaaagtaggagggacactggaggcacatgatccttttggtaaaaggtggctgagcctcctataatggagttgattcatcatgactgtcactggactaggtgatgacacatgctgtcagatcgtagccactttcccagctgtttgcctacttgcctttctcagtggctagaggtagaagatgatggagccttcaacctcagtggaccagctcagtaaaaagccaatgaaccgcttgcataagaacagcaaacattcccatctttataggctgcactcctatctgcctaccctggcaccttgctagcatttttaaggtagtaagaggcctgtaaggaagaggaagcattgcaattcatgcaaatctgactccgcagctctactccaaaggatagtttcaacgttctgggctgagtgggagggatgaaagatcacacatcacctacaaacagggataccacccatatcagacacatttatagtcacagaagtaaatgatgcatggatcagaggatacatgcctcaccataaagttctaaatatagtttacactctacccgaggatattgctttcatctttgttaaccagaaaatagattaagcaaaggttagctggtgagacatgtacaaatcctcaagtcaagctgagtattctgagagcctaaggtgaattttttcttttcccctaaaagtacaacttttacctgctgagtgtaacgatctattttgacttgtgcctcaggacagagttcgatatctttggctccatagacagcctgggcaatggtccttatcttgtccacaattggaagctgcagaaacacaaattataaaaaaattgtgtaagtttaatctggttaaagatttttttaaaagtttagtgacacttactgtaattgcttaaaattcccttatcagggtaccccctcagcaactgcaggattccttgcaaaccctcttttttccttttagcaccctaaagcactgaaattttcagtgtcagaatagatcggatgtcaactagcaaataagccttaggtgttcaggcaatttagaggctgcctagagcccatgtagaatctgcagagggaggccgggcacagtggctcacacctataatcccagtactttgggaggccgaggcgggtggattacctgaggtcaggagttcgaaaccagcctgatcaatatggtgacaccccgtctttactaaaaatccaaaaaaactagctgggcttggtggtgcatgcctgtaatccgagctacttgggaggctgaggcaggagaatcacttgaactgggaggcagagactgtggtgagacaagattgtgccactgcactccagcctgggtggagtaggactccgtctcaaaaaaaaaaaaaaaaaaaatctgcagagggaagagggaagttagtgccttacagagggcttctgactaggaagccccagaactgcggccgaccccttcctctccctgcctcacccctgcagaaagatctgcagaaaaagctggaaggggtgggatggtgtgtgtgggggtggggactggggctatgcagtttccagacctggtctttggcaccctctacaggacagttccattcccacacctgagctttggacaactgaatcctatgccccttcccacccagggaacctggtgccagaaattcccaggacttacccaccatccaccacgccacatagcaagtgtcctcagtgtctgcagaccagaaacaactcccttgtgtctcagcactgggccacctgctgaaaccccaaactgcctgccccattgtttgagacccagtcaggccttggctccaaaagtcctcttggactgccactggcccccagggtctctcctgactgcacctcggtcccggagctcccacaccgctgggccccgagccccatgccccgatccagctgtggctcctttacgggggccttgctggcctttcctaagggaggtgttttcccgagggcaggtggactgctcctcagactaggggccctcggagggccaggcctgggcttctacctcctctcgcaggctggtgtttctctgcaaatatggctcgtgtgtcctccttcctctcagactgggggcccctgaggactgggcctgagtttccctctcccccttcagaatgggggttccctgaggactgacccagggcctccccccgtcccctccatctggctgttaatctccaacacttccacctccagtcctattctgcacagcgctccccagcgctgggagctcagaggcctcttcagccttccccagggctggggctcagggagggcttcctcaggcgctggccccagagtcaggctgcacattggcttggaggacaggcctttcctctgggactgtgaggcccagagtgcccacccagaactccacctctgacctcacaaaggcctgcttcagaactcagtctccactgcactgctggccagacgagggaagttattttgggcagtgcatctggacttggttcaagtggcaccagccaaatccctgccttactgacctctcccctggaggagcaggagcagcgctcaaggccgccttgggagggctgagaggcaggctctggactggggacacagggatagctgagccccagctgggggtggaagctgagccagagacagtcacagaggaacaagatcaagatgcgctttaactgagaagcccccaaggcagaggctgagaatcagaagacatttcagcagagtgagtggggctccaggcagggtggggatggggcagcctcctcagtgcccagatctggaagggtcattccctgggtaccatacagcgaggaggtgactgagggattgtttggggaaggagccccggctgggagtggaagtcccggctttcttgttatggtgcagtcctgtgttgctgtgtgacacaggcacatacaccttctctctgggcctcagtttccttacctgtaagttggttgttgggaggaccagcggtagagcagagatggcagggatgcactgggctgggctgtcagcagaccatgggggtgggacgaggagagagctgaagaccaccggcagtggaccacagggggaggcatgcaggccagagacgggtcagctgccggcttgctggagtcattcctcccacgcagtcccctcctgaggggctggagctggggctggagggtttcagcagtcagggctggagataagagtctgtgctggagctagagggaactgggctagagaatcaggaggacagacagggtgaggggacttcgggctaccttcatgctgtctgttagagataaagataggagtacaaaggggaatttttgggtgaggtacacgggtgaaatgagttttcagggcctcatcctgtgtgttcaccttctgtgtgtgtgtgtgtgtgtgtgtgtgtgtgcatgcgtgcatgtatgtgtgtgtgccggtcctggacagtcacagcttaagttagcagcaagagaacttgaggttaaaggtatagcacgcaaatatgaggctggagccactgagtagaggctgagggcatctccacagtccaaagctgggctgcagacagggaaggtcagcaggagcactggagggtctggcctggggttggggtcctggggccagcatgggtggggtggggctccagggcgtcgcctcattggctgagcaccgctcctccctccctgttccttggctgggttaagggagtggcactagcaggagctgccccagggcttctcccctggggacaaagatctgatggaagtgtggggccaagttctgtgtcctccagccctagtgacctctctttggctcctcagcatctacaaatctgaaggacaaaacatggttcaagcatctgggcacaggcggtaagtaccccaccctcttctcaccctccagccccctgtcctccacccagcccacttcagtgccctccctgctccatcctcagcctctcccttggggcagctgtcccccctcgacctcctcctccccacccacccactcgcctctgaggtcccagaagaaaagcatcttccacctgttgcctgggctgggtcctggggtgaggggaggctcagaaatacttggatgagggtcaaggcatgcaggtggccttcaactcaactgcactcagcacctctcaccctctcaggctcagctgtctttggggtgaaaaagagccagtccttgcaatggccaaggccctgcctatgtagtccttgttagctttctggcctccccactccagccccctgctctccctcctccagccacactgagtttcttttctggtttttttttttcttttctttttttttttttttgagatggaatccagttctgttgcccaggctggagtgcaatggcaagatcttggttcactgcaacctccttctcccgggttcaagcgattctcttgcctcagcctcctgagtagctgggattacaggattacaggcacacactaccatgcccagctaattagttgtttgttttttttttttttttttttgtatttttagtagaaatggggtttcgccatgttcgccaggctgttcttgaactcctgacctcaggtgatccacccacctcggcctcccaaaagattgggattacaggtgtgagccactgcacctggcctcacactgactttctttgctttcttcaaacatgctgagagtcctctggtgactattccctccatctgagaggctttctgcagttaacatacagcccactctcatctccttcatggctttgctccaaggccaccttctcaacaaggattactctgactgccctatttgaaatcacaccccatctccagcccctgcactcccaattcccctctccttgctctgttttttcccataggagctggtaccttcgcttatacaaatgtacttacttattacatttcattgctgtcagctccacgcaagcagggatatttgcctgttgtacacttggacggagagaatgaatagtgcccctctgttgacatcattgcctctagcctacgtctctttccagggctttagatcctgtttctagagacccactggtgtctcacaggcaactcagctcctagatggaaacagcctcctccgccccccacaagtccactcctcctgtgctcttggctcagtcaggggtccccttctcttcagttgctcaagccagaagtcaaggtcatgtccttgatacttccctcttccccatgcctcacatccagtcaccaatctcctaaaatatctagaatgtgcacagcttccaccattctttctaccaccaccctactcccccatggccatgtcaggccaccacccgcccattcttcaaaactcccttcaggcctcacctcccatgcctcccctgagttcccccagtcccaggctgcttctctctggtggtgttgccattacccatctcttctattaaacagagtgacccaagagtggagagtgggttttgactttgtatccctggtgcttgactcataagtaggtgctcaacaaaaattttttctttttttgagatggagtcttgttctgttgcccatgctggagtgcagtggcatgatctcagctcactgcaacttctgcttcttgggctcaagcgattctcacatctcagcccccaccccagctgggattacaggtgcctgccaccacgcccagctaattttttttttatttttagtggaaatggggttctgccatgttgtccaggctggtcttgaacttctgacctcaagtgatccacctgcctcggcctcctgaagtgttgggattacaggcatgagtcaccatgcctggccaacaaatgtttgttgaatgaagaaatgttggttagcaggttgaattgttggctcgtggttagttggatagtttatggttgactggttgattagataattcaatgagttaatagctggttaacaggagaatcagttagttggtttttgataggttagtcaaagggttaataagccaccgggcatgttggctcatgcctgaaatccctgcaccttgggaggctgaggctggaggattgcttgagtccaggagtttgggaccagcttgggtaacatggcaaaaccccatctctacaaaaaataggaaaaaatagccggtcatggtggcatgctcctgtagtcccaactacttgggaggctgaggtgggaggatcacttgaaccctgggaagtctaggcttcagtgagctgtgactgtgccactgcacttcagcctgggcgacagagtgagaccctgtctcaaaaaaaaaaagaaaaagaaaaagaaaagaaacaggcgttagtgagttgttagctatttagttccttggttaacagattacttaggggatctggttggctgtcagtttcttgctttgtaggctggctttcttgggcccctcttcttagtctgtaccctctccttgagctctctcatctatgcccatggctcagatgaccatctgtgatttgctgtcctccaaatgtgtctgtaagtgagaccacatgaccagctgcctcctcactggccatcccacccaagtgtctagcaggctcctcacactcaacatgtccagaaagggcctccttgtccattcttccacagcttctctgctgtgccccacgctagtcattccgctgccctagccaggacctgagggcatcgctgagctgccccgctcccttccctctctaaccgaacaccaagcctgtcagcttgactgtgttcttgtggccattggcactgccatccttgtggctcagactgccaccacttctccacccatctgtggagaagctgatgctcaccctgcctccactccacttcctccatcctggcctccacaggggaggcagctctcctgctgaaaccctccacttggcccatggccctctggtagagttcagactccctaatgtgggccatgaggccttctgccacctggccctggcccctctctgcccatctcatgccacctccactcctccgtggccagcccattcctgcacattggatactgccttagctgcaggcctttgcacatgccagtcctacgcccagagtgatccctgcctccctggaggctcctttaccctccagccttcttttcttgacctgaatttccctttctctgggagcctcctaccccctcctctaggccattcacttcctccacatgccccacagtgcccactctttcagctggggcaatgctcatcacactgcatagtaattgctcaattgattgcttttcttcccacaggctggattgtaccagtgtcttttactgcagtgactgaacattctaggcacagtagattcaagaaatcttgagttcattggctggttggtggttatctgttgcttactgtgtcttgcctgctgtgtggtgatgaggaaggagccaggcttccaggattctcttggtgttcttgtctttccgctctgtccacttctctctcctcttctgtggttacctccagcatgggaggtggggttggatgggagccagtggagggtcacctcgccctgctagggagagcagcagcattcctcagggctcctaaattcccctgacctcacagcagcaaaaagtaagcagagggaatgagagacgtccaggcatggaataaaacatcttccacttttcagctgagaccctctgttcatggctcacccatcccagtccttgctctattccttactccagagaaacaaaaccagggatgagtagatggagggggatgcagagttgcgcggatattccactggcccccatccaactccagctcccatgcagcatcgtataggggtctcattatcccatgaccagcctcctcagccctgaagaagagaccctatcaatgcaagcagcagcccaaagacagtcctgggaaggtaccatagaggcaggggagaggtagacagagcagggagccaagaacaccaagggaatcctggaagcctggctcctttctcatcagcacagagcaggcaacaaccagccaaggaaccaaagatttattgaatctactatgcctactatgttcaggcactgcagtgaagcaaactggtatgatcccagcccttaggaagaaaaaccgttaattaattaagctttttttttttttcttttttgagacagggtgtcgctctgtcacccacgctggagtgcagtggtgtgatctcagctcactgcaacctctgccttctgggctcaggcaatcctctcacatcagcctccccattagctgggaccacaggcgtacaccacaacacctgactaatttttgtattttttttttttttgtagagatgaggttttgtcatactgcccaggctggtcttgaactcctgggctcaagcgatcagctcgcctcagcaagtgctgggattacaggcgtgagacactgtgcctggcctaactgagcaattactatgcagtgtgatgagcattgccccagctgaaagagtgggcaccgtggggcatgtggaagaagtgaatggcctagaggagagggtaggaggctctcccagagaaagggaaatttaggtcaagaaaagaaggctggcgggtaaaggagcctctggggaggcagggaaccattctcggtgtaggactggcatgtgcaaaggcctgcagctaaggcagtacgtgatatgcaaggatgggctggccagaggagttgaggggctggtgtcagcttccgggcatgcagacagtgagatagcagagtgactaaggccacacttagaggtatctgtatccctcttcttcctctttttttttttttttttttttgagatggagtctcgcacttgttgcccaggctggagtgcagtggcaagatctcggctcaccacaacctccatctcccatgttcaagtgattctcctgcctcagcctccgaagtagctgggattacaggcatgcgccaccatgcctggctaattttgtattttttagtagagatagggtttctctatgttggtcaggctggtctcgaactcctgacctcaggtgatctgcccactttggcctcccaaagtgctgggattataggcgtgagctaccgggcccagcccctcttcttcctctttatcctccagtcccaccccgccaccttccccaaactccagtcctatacctctccctatacgcagatttggaacctgttactcacctgtttcatctacctttccatctaaccgtgcacttaactaaatataaatcaagtgccaggccctttggcaagctctgaggatctagttgggagtaagacagattccccagttttcacccattcaacaaatacttattgcacatctactatgtgcctggcatggtgctgggcactaaagatacaccaggaagtagatccagtccttccttttctccctcccgctctcttggtcattcattcattcattcactcactctctcacaaacctctgtttgcactgacctggttgcacagcctggtgcattttgctgaccccttcatttttgacagaacctggcgcatgtttcagtgctcagtgctgtttacagagctcggcagcagactttgtcacacttcatgctgtttgtagagtgcctcactgttgccaggccctggcctgtgaccccaaagttctggctctagcagataggcagacagacagatggacagacatagactactgagctctactttccagcctgctctctcccaccctactttttcccagaggcttgttggcaccgtggattgcactttcagctccccacctgtccgtctgcaaagtggcctcattggtgtgccatttttactggtccagtcccaactacaaggggcatggcttggccatctaccccagttcctctccatgtccccatggctctcaagtgtctccaattccagctgtcccagctgccccgggcaagaggaggtgtgtgtggcaagtctgctgggttacctattaactcagctgtgagttgaagagccgatgggcagcaggcagacttgagtctcctttctgtccatgagctcgggccactgtatcaggtccacccgtggctccaaaatggtctcctggtccgtgatagcaaagatccaggaaatatgatgcgaggaagatgagaggaagatggcgcgagagttcctggccgagttcatgagcacatatgtcatgatggtgagtgggcgggcagcacgaagtgggtgggctctgccagggccttccatgaccccctccccattctgaccccatgggtcacattgtccattccttgcctctgagctgggagcctggggaagcagcgaggaaagtaaggggggggggggctttctcatcaagtctttttggacagaaagggctcataatatgtgggggtcaaatgaaaccatgcactggggtatccggggcaaggctggaaatggggagaagggaaacccagagtaaagagattgaagaggcccaggtgcagtggctcatgcctgtaattccagcactttgggaggcttaggcaagtggatcacctgaggtcaggagttcgaaaccagcctggccaacatggtgaaaccccgtctctactaaaaacacaaaaattagctgggcatggtggcggacacctgtaacctcagttattcaggaggctgaggcaggagaatcgcttgagcccaggaggtggaggttgcagtgagctgagatcacaccattgcactccagcctgggtgacaggagcaaaactctgtctcaaaaaaaaaaaaaaagaaaagaaaaaagagagagagattgaagagaaacttgatgatcaggctctgataatgaatccagagggcaatgggcgatgttgaaggctggcaagcaggggagtgacatgatcagatttggattttaaaggtaattttgggtgcagtgtggagcataagcaggacaggcaaggctggcaagaaggaaccagttaagaggctgtttttgatctgggacagagagagggtgatgactgatctggggttggagaagaaagcacatgtttgagagggctgtggaagatggaatcggggagactctgccagcagaacatgtgggcaaagcgccgatgagctgttctggagcacggggcccagcacagggtgagaggcaagatgcctgtagggaaatccaggagatagttaaacacaggcaagggtctggagctcaggagaggcttggtctggaaggaaaaagttgaagttcatcacaacacaggtggtggttgtcaacactgtctagaaggagtgtacagaaagagaaaaggatggtttgaggacagagccctgaggaatgaagaggggcacgcaaaggagcctgagaaggaatggtcagagaggtgggaggagaaccagagccgactgcatgacagaggggggcagtggttccaccaggaagaagccatcagcggcatgggcagcggcagatgggccacgcaaggtgagcactggcaaggggccttagggtttgccaatgtggaggttgctggtaaccttgacaagggctcttctttagtgtgtgattgggacagaatccagactgcaggtgggatgtgaggttgctccctctccacctgcttcagccctgccacttaccccagtgagcctctgcccttaacatgactgtagccatgtttattgcatcttatgcagggtccagggtctagagaaagaaggggcagcctctgggaagggaggcaaaggcagccaggtgcatgctagaggaaggtggggtgagagaggctgttcgtgtgtgtggtggggcccatggagctcaagggagagaggaaattggaacaccaggtttcttagcctgaccctgccactgagtgaccagttgccttgggcaggtctctccctggcttaaagcctgacttctcacttatatcgtgtagaattaggccttcgtgggctttggagctgtgtttgaatcctagctctgttatcttctagctgtgcgactatccacaagtatcttaactgttcacaaatttagctttcttgtttttgagacagggtctcactctgtctcctaggatggagtgcagtggtacgatctcagctcactgcagcccccacctcccatactcaagtgactctcttgcctcagcctcttgagtagctgggactacaggcatgtgccactgtgctcagctaatttttctatttttagtagagatggggtttcaccatgttggccagactggtctcgaactcccgaattcaggtgaccttcctgcctcggcctcccaaagtgctgggattgctggcgtgagtcacctctcccagcccacaactttagcttccttattggttaacaggaggacttgtgtgaagaaggccaagtctcagcacccagtgtggtacccatgtattggtcccttgttattaggacgggtgctctagctgctgtctcctctctgtctctggccctcccctactcctctcttacctccccacctgctttggctcctgagctgtgaggacagcagttggatcctgtccctccttaatccagggcaaagtaattcacttaccacaagacattccagccccatgagggctgttaacccttggagcctcggaggcaggagggtgcatcctctgagagctgttagggaaataggcaccgcccacatgcttgatacctgcccacatctgtgttcctcttccttttgttgagattttcattgagcacctaatgcatcccgggctctgtgatgctaagccccttacgtgcagcatcttcccaaatcctcgcaatagccctgtgaagtaggtactattattatcccagtttcacagatgggaaaactgaggctccttgagactaagccttttgcccaaggtcacactttaagtcaagattaaatccagtgcagtctaatatcacagtcttttttgtttttgtttttgtttttttgagatacagtcttgctttgtcacagtggtgcaatctcggctcactgcaacctctacctcctgggttcaagcgattcttgcatctcagcctctggagtagctggaattacaggtgcatgccaccatgcccagccaatttttgtatttttaggaaagacaaggtttcaccatgttgtcaaggctggtcttgaactcctgacttcaagtgatcctcccacctcggcctcccaaagtgctgggattacaggcatgagtcaccgtgcccagcccaatatcacagtcttgacccttaacctctatgctctgtaccttagcttaaatattgccagcttttaaagactcgcttgttaatgctcccccagccagggtaaagtcctcactttcaggtagttcaagatgcctctctcggcctcagtttccccatttatagagtgggagaaaaattcttgctgtgcagatttgttgtgaggattgaagacagtagcacttgtaaaagaactttgtgaggcgtaagcctaaatcggatattgtggtgttgttatttttagttgccaggctgtgccaagaagtgagggcttttttttttttttgtaaatatatatataggaatctcagtgagtcaccagggtgaagttttgccaaaaaagctagtgtgaccttggccccatttattgcagccaggacaagggaagtggactgatccgtgttgcagcttccaggtgtgttgcccttggagctggcctcctggctgtgggggagagttggatgggctgggccacattcactgatcagggagaggaggggctggagccatccgggccctggaaaaccagccatacacatgagacacggggcaagggttgtagatcacatgctacgggggccaagagagcggcaactcagggcggtggggactttggctggctgcagagtgccaatctgtgcaaggctgtagagctgctgccactccagctgactgttgccatggagggtggaatgcaggccagtgttgcttgagctgctcatttttcaagagagacggaaacttctgttcttcaaaaccaagttatctaaacaaaatctgtgcgctggatgaattaggtgcatgagttgccagttggcaaccctgacacaaggaatcatgtggggttcattcattcacccagtattttattttatttattttatttttttgagacagagtctcaccctgttgcccaggctggagtgcagtggtgtgatctcagctcactgctctgcctcccgggttcaagtgattctcctgcctcagcctgccgagtagctgggattacaggcatgtgccaccacacctggctaattttttgtatctttagtagagacggggtttcaccatgttggctaagcaggtctcaaactcctgacctcatgatcggcctgcctcggtctcccaaagtgctgggattacaggcgtgagccaccacacctggcctatgctcatccagtatttttagcacatggtattggaatgcgggaaaggccatgggggcccctctgttttcagaccctccatgcctcctccagtccctctacctcttgaccctgccagcctgtcaacctgtcctgacctcactcccccctgcacccccatctgttcctgtcctctcctgctgtatcttatcctggatctgaagccagcctagctctgggctcccctgctcctgtcctggggcttctgagggacccagtgggccctgctcagctgcctctcccccaccatatctgggctatttcacattttctcagacttccccaaagctgctctgtactctttttttttttaaatcagcaaatggcttgatctgctgcttgataggtaaaataatcaacacttcctatgttcagctcaccctcttgtccctcttaccaccagacccattaaccacccgtgtatccacatatcaccccttggctggggtggggtcctctccttcctggaggacacctccacttctgcaccaatccagctgtccagcctattcaggtactttactctgtcctttttctctgtcctttatcttcagcccatccctctctcagcctataaacatactgaagtttctccactgaaaacaacacaaaatgaaacatccctcccttcaccctgtcagccccttcacgggatcatgttctctcttccccgctcctcaggcgaattctcgaagaggagtctacactggtgcctttcaactcttttttttttctttttttgagatggagtcttgctctgtcgcccaggctggagtgcagtggtgtgatctcagatcactgcaagctccacctcctgggttcaagcaattctcctgtctcagcctcctgagtagccgggattacaggcaagcaccaccacgcctggctaatttttgtattattagtagagacggggttttgtcatgctggtcttgaactcctgacctaaagtgatccatccacctcggccttccaaagtgctgggattacaggcatgagccaccgcacccggcctggtctgccttcttaccttgtaccctctcctggggccttctcctctgtcggctttgactttggcccttatgtctacaattcttcaggttttctcctttatcaactctagaacagagttctccaggggaaatacaatacaagccatctgtataatttaattttttctagtatccacattaaaaaggtaaaaagcaacaggtgaaattaattttaataattaacccatatagccaaaatcctatttcaagatgcaatcaatgtaaaattattaggatattctggccaggcatggtggctcacacctgtaatcccagcactctgggaggctgaggtgagaggattgcttaaggccaggagctcgagaccagcccgggcaacatagtgaaacctcatctctacacaaaataaattgaaaaacttagctgggatagggctcaatggctcatgcctgtaatcccagcactttgggaggccaaggcaggctgatcatctgaggtcaggtgtttgagaccagtctggccaacatcgtgaaaccctgtctctactaaaaatacaaaaaaatagttgggcatggtggcatgcacctataatctcaactactcgggaggctaaggcaggagaatcacttgaacccgggagttggaggttgcagtgagccgagattgcgccattgcactccggcttgggcgacagagcaagactgtctcaaaaaaaaaaaaaaaaaattggctgcgtgccgaggcacatgcccatagtcccaactacttgagaggctgaggtgggagtatcacttgagcccaggagatggaggctgcaatgagccctgatcatggcactgcactccagcctgggtgatagagcaaaaccctatctcaagcatcaaacaaacaaacaaataaaacagaggcacaagaaagcaaggcatgcatggagcagcgcagttgtttggtttgaggccatctggcacaggtaactgcctggatttaatcctggctcaccatgtacaggctgtgtgaccttggacaagccattcaagttctctaagcttcagattacccatctgtcaagtgggggagaataatagtgcttaactatcatttgcaacatctgagtttctggctcggccaacggggatggggaacatagagtgaggagcaggtgtgctgtgagatggcgaaccttcaacagagcctgagacgtccgcggaacaccaggagagttgcagtggggatttgcaaataggcatctggctcccccacggagatgacgggaatttcagcgcatcaggcatagctgagactgtctacgtggtaaaaccatgcctgaaaagacctttggaaaatcaggaggttgctggagcccttggagagagctttggtgtctgtgacatgtggaaatggaagccagattgaggagggggtgcgagggaaggggtgaagcagctggccagtgtgttctctcctgcagcctgactgaaacagggagggggcaaccaggaacccacagctggagaaggacactgggcaggggtgggacagtttgctgggaaggatgagactccagtgtgtgggaaccgatcaatgggaggatggaaggtatgggggagacggaggcctctgcagagggagaggatagcacaggagccagggctgaagggaacagtggctctagactgagggtaatgggcctgaaggtaggccccttcccctgtgaaggcagcattatctgaggagccgtgagggatgggcaagaagcagcagcttgggaatgccgcctgaggtcagtggaaatgaagctgagggcaagacagttaggggcccactgttccagcattgtgggaattgcggtggagtgtgtgtgtgtagggaggggttcctggcagagtcaggcatggatggatttggaggtcccttgaagaaacttccttcaggtcagcctgaagtgtgagggactctgagggggtgcaatgcatgccagccatcccctcctcgcagccctgcctcaccccaaaacttcaggtgggcctggggctgaggtgcttggatgtttgtagtaagagcttctaactctgccgctccacccggctctcagtggctcaggtctgagaggcctcagcaggggcaaggagaggaggcagtgaggagggaaggctctggaggaagagggcatggcagagggtcttcgaggcaacgccagggaggcccagggcatgagggtgaggagctagaactgagctctgagccctcctctgaggttggggcttctgggcaggcagcccccttagaggccctcccttgtaggtattcggccttggttccgtggcccatatgcttctaaataaaacatttgggagctaccttggtgtcaacttgggttttggcttcggagtcaccatgggagtgcacatggcaggccgcacctctggtgagtgagcccaggccctgccggaccgggcaagaccaggtgtccccaacaggctctttcctgcccgcctcagccagctcctttgccagcacagccagtgcctcagcctggccaccgggcgggaggaagtctcctctgaaccccgtgcctatgacgtgtctgccccagattcttcctggcccccccgacctaccattttcactggctgggtcatcttaggcaagccatcgcctctgtgttcctcagtttccttaagagtgaaaggaagacggtggcccctgcctcacggggtggttgtgagggctcaaggagagaactctgtcacggagcatgctgtcatacacactagccatcgttgttctcatactgtttgtcactgttgtttgttctgctctcactccctgacacacttgcctgctgcccgcaggagcccacatgaacgcagctgtgagcctcactaactgtgcactgggccgtgtgccctggaggaagtttccagtctatgtgctggggcagttcctgggctccttcctggcagctgccaccatctacagtctcttctacagtgagcgtcctgcccgggtgtccgcctctggcctcagctgcctcctatgaaatatgggcagattggacctcagtgtcctgatttgtaaaaaatagctgggagaaaaaagccttggaggtctcccaccctctaacctataacctaatttccgggaccctggtggggcttagctggggacaggttcgcatgatagtctgtgtctccacagcggccattctccacttttcgggtggagagctgatggtgaccggtcccgttgctacagttggcatttttgccacctaccttcctgatcacatgacattgtggcggggcttcctgaatgaggtcagtggtccaggatgagtacccctccccctgccctccacccctcaggacggagccagcagggagtccctccggatagacaggacaagaactctggatggagactgtaccaagatgtgtctctgctggtgggcttgggtctggggcactgccgaggtcctgtggcttggggaggggcccaggtgagcttccacagcatctgctcctcaggagtggctgaccgggatgctccagctgtgtctcttcgccatcgtggaccaggagaacaacccagcactgccaggaacacacgcactggtgataggcatcctcgtggtcatcatcagggtgtaccatggcatgaacacaggatatgccatcaatccgtcccgggacctgcccccccgcatcttcaccttcattgctggttggggcaaactggtcttcaggtactgcccctgcccaggcccattcctttgagattttctgtggggcccctgtgtgttgaggtgtggggggtgatgtgaggggcagcacaggagggtcctgcagagcccccaggtggcctggggagcaggagtgagtcccaacatttccccaggccagtacagatacagatcctgcacctgcactgagtgtcaaccctgtccctgaatcgggctgaggctgaccagggccccgggttgggggtgtttcctgggttagcctgaggatgactcctctgctcaaccagtcttggcccgaggtggatgagggtgctgtcctgggcatcagccccctcagccggcctctgcctcttgcctgcagcgatggggagaacttgtggtgggtgccagtggtggcaccacttctgggtgcctctctaggtggcatcatctacctggtcttcattggctccaccatcccacgggagcccctgaaattggaggactctgtggcatatgaagaccacgggataaccgtattgcccaagatgggatctcatgaacccatgatctctccccttaccctcatctccgtgagccctgccaacagatcttcagtccaccctgccccacccttacatgaatccatggccctagagcacttctaagcagagattatttgtgatcccatcccttccccaataaagagaagcttgtcccacagcagtacccccacttcctgggggcctcctgtggctgggcttccctcctgggttcttccaggagctctagggctatgtcttagcccaaggtgtagaggtgaggcacctcaagtctttcatgccctgggaactggggtgccccagggggagaatggggaagagctgacctgcgccctcagtaggaacaaggtaagatgaaagaatgacagaaacagaatgagggattttcaggcaagggggaaggaagggcagttttggtgaaaggactgtagctgactggtggggggctggctttggaaatactttgaggggatcctgagactggactctagactctcccctggttgttcccttccccgagttctggccggttcttggaccagacaaggcatggcccaagaaggtagatcagaattttttagcctttttttcattagtgccttccctagtattcttccagattttttttcttaatcacatgaaattttaataccacagatatactatacatctgtttatgttctgtatatgttctgtgctttatacgtaaaaaagagtaagattttttttcacctccccttttaagaatcagttttaattcccttgagaatgcttgttatagattgaaggctggtaaggggttgggctcctctttcttcttcctggtgccagagtgctcccacatgaaggaataggaaaggaagatgcaaagagggaaatccttcgaacacatgaagacacaggaagaggcctcttagggctccaagggctccagggaagcagctgcagaggttgggtggggtgaggggccaggatccactgaccctggggccaggcaggaatcactctgttgcctggggctcagaaggcagtatcacccatggttcctgtcattgctcatgtattttgcctttcaacaattattgtgcacctactgtgtgcaggccctgcctggacactggggatgcgcagtggatgcactgggctctgcctttgagggttgcagtttaatgggtgacaggtaattataaggaagaaggtgagtgcagagtgggaggcttggaggctgtggggcttggggtgggggagctcacatccagcctctgggccaaggccaggaggcttcccagaggaggagacagagcagggtattgtggtggggggtgtcctttttggggctgggattgcactttacagtttgaggggatgggcagaggaggctgggcttcattctggaggtggggacatggtgaggtgaggtttagaaagcacacctgagccgcagtgtgtaggatgctggaaatggtggagatgggcctgcgaagagagtgctgggaagtgatgacccaggagcagcagccgggcacctaacaatgggtcagcaccgtgggcgtggagacaagggccgggattgatcaatacccgagaagtacaatgtacaggacttgggctccatttggatggagtgggtgagggaggagtcagaaatggcttccggtttccagcttgggcctggggattggagatgtccccactgagagtagggcacaagtgaggaaattgtttggagaggaagatgataagttacatcatggatgtgctgagtctgagttgcctatgggacttggaatggggggtggcaaaaggtgtgtgatcttgagcaagatattcaactcttctgggccttggtcttctcatttgtaaaacggtgataagaatattacttcccatttgtgttgctgtgaatattaaatgcgctaccacatgtaaaatgttgagaatcgtttctagctcagagtaagtgctcaataaacaccattatgccttttatatggtctggagctcagaagtggaagacagggttttgtgaagtcatggctttgtggatgtagctagattgtggagtaatggcaggagggtcgggggcatggcacaaggtaggtggtcaagagacactggacacaacccaaatgtccatccacaggggaacagatacatacactgctgcgcaattgcacataatagaatcctctacaatagcaaaaattaaggcacaacagacacctgcaacaacacagaaaaattctggaggcataaaaagtaatacagtagctgggtgtggtggttcacacctgtaatcccagcactttgggaggccaaggtgggtggatcacgaggtcaagagatcaagaccatcctggccaacatggtgaaaccctgtctctactaaaaatacaaaaattagccgggtgttatggcacacacctgtagtcccagctactcgggaggttgaggtgcgagaactgcttaaacctgggaggcggaggttgcagtgagccaagatcacatcactgcattccagcctggcgacagagcgagactcggtctcaaaaaaaaaaaaaaaaaaaaagcctggtgtagttgggcacctgtaatcccagctgctcaaaaggctgaggcaggagagaatcccttgaacccgggaggcggaggttgcagtgaatggagattgtgccactgcactccagcctgggtgacagagtgagactgcgtctcaaaaaaaaaaaaaaaaagtaatacggtagactatatacagtgtgacacaaacttgtagctgaaaaataagcaaaaacacattctttgatatatatatatgtatgtaagaaaactactttagaaaaagaaataattcctacaggcagatggggaagaacacaggagtagtacaagctattaataattttctagttttggagttggacatttgtgagtttattatatgattgtgcttgataacatataaatgtgatacatattgtttgtatgagatatatatatatatatatatacccacacacagatagatgattgctgacaaggagtttctaaagatcatatatatatttttaggtaaaatagaataacattctgcttctggtcttcataataaaagagaaatcaggactaagaaatcaagtgtttattatatagagttttaatttttattcttttatttattgatttatcttctttaggcatgtgcagagatgaactcactaattgttcaaaataaacaatttgaattcaaagcaaagtatatttttggaatatcaattatcacttattgcagataaatgataatataaaacaccaactttggaatttatttgttttacttctgtgactctcagccttctttttaaaatatagtgtatgttttaggtaagttcagacagcagccagcactacatttggtttaaaatccagctttataatgacttcatctttcaaccagccaaagggtagttaccttgtgtctgccatcgtgcatatgctctcagctcctgactgagaaaacatgcctgcaagcacttccctgcctgagattatattaaaaatccatacctgtgctagcagcatgagttcaagttgattattgttctagatctgtgacttcccattcatcctcctaaagatataaatgattgcttttcaatagaccacatacttaggaatgattatgaaggcaaggtttagtaacaataatatacatagtactctaatgggattgaattggaacacccacattaaactctcttaaaatatatggagcagaacacatgagagaaagcaaaagaacaagtgcacacagcagagctgcgagttgcatactctgtgcatgctaataccatcgcaacaacatcactaaggcttctgggtaacgtttgccacatcatattgtgacgtgcatttgtttttatattttaccctaaaaggcaaaataactctccatgtgatgaaagaaggagcacacacaaaaaaaaccctctcagaaatattaaaatggttgcaggtaattcaaatggtatactgttttaaaaggtacttgtctaacactttaagttggaaaagcatcttggaagtcattagattcatatttacattacttgaattgtgaccctagcttgacatttccatggtgggagacatattttatttaggaggcagcagtctatttagtttttgagagcttaatcgatagatggttcagattttctactgaaccaaaatctaaatgcctacccattggttttcgtagccaacgtcaatatccaactgctctttcatacaacatggcttcaaaggctatgtaactaacatcatgccactgcacctatgtctttttaaagccaagtacctctagtgcccctcattatagctcatatttcaaggtatctttcagcaacaatgaattgcattaatcaaactcactttttttgcgtgtgcttcactttatagctcttcacaaataacacatttttcacaaattgaaggtttgtggcaatcttgcatcaagcaagtctattcattctatttttccaacaacgtgctcaccttgtgtctctatttgacattttagtaattatcacaacatttcacattttaaaattattattattattttaaatattttaacttttaggttcatgggaacgtgtggaggtttgttctttaggtaaattcgtgactcaggggtttgatgtacagattattttgtcacctgagtagtaagcatagtacccaacaatttttttttccctgaacctcacccatctctcatcctcctccctcaagcacaccctagtgtctattgtgctgctctttcagtcaatgtgttctcattatttagctcccagtgataagtgaaaatagggagtattgggttttctgatcctgtgttactttgctaaggataatggcctccaagctccatccatgttgccgcaaaggacagatctcattcttttttatggctgcatagtaattcatggtgtatatgtaccgtactttctttttccagtctaccactgatgggaatttaagttgattcctgggtatctattacctaaattacatataaaagcagaaaagaaaaatgacaagtagaacatgaaagttaaacagtatcttttcaggttcaatgacataaatattcttattatctaaaggtataaagtctaatgttttatttcctatagtgcttttatagcaaaacacttttcagaattagataaaccagattgaggccccagtcttactacctattagctaggtaaacttgagctttgggattttcagattcagatcttgcaggcaaataagatttatttgatattacttgaggatgacaatgtctatcttgcagattattatggtaatgagtttatttatgtggattgttttaggatattttaaaactatgtacagacctaaaaaaatcctcataatctttgcagaactgggaaggcatacaggcataatacaactgtaagagttactgtttctcatgcttttgttttctaactgctctggccactgttttagaaggaagggtgaatatatgtaaatattcctgaaaaaataaagttttagaatattaaattattacatatttcattcagaattttttgaaaggtaaaaccaatgattgaacgtagttcatgggatgatctggtccatattcatctaccatgatttaacaaattttttttctcatctattgatgaggaaaaaattaaggggaaatgtagaaatgtaaggtaaatgatctgcaaagaaatacacacaggaggtatgtgggaatgtaacagtgtaggtccgcaggcaaactaggtgaaggaggaaggtgaggaagaaaggaatttaagacttactctttctgttttcttctcaattttaaagcctgatggaatataattttctctacagtaaatgttgaatgaaaatcagttttgtatgtgttaataatgacttcaccaagagcatttgaagctctgtctatcatattttgatgctcaaaataaaacattgtttttatagcttaatagtctcatacagtcaattattgcctcccctccagactgacactttgaacattattattaacactgctgtccttaaaccatcatcggcctgcagtgcagacaatttattgatagctaataaaacagtgttcagatgctgcctgagtgcaggattcagaattgtcataccaatgcataaccacatttgatcttttggaacaagttccattacttaaaaattatggtttcattttcttatttttatatctagattttaacattatatgcatgcctatataagcattaaatatgttattcagttatgtgtgagtgtaactgaaatttcttgtaaagtgtatgtacagtttaatataagacagattattgattaggaaatagttaacaattaataatagacattggccaacctcaattactaaaccagaaaataagtttatttatttattgtattatttttttattatactttaagttttagagtacatgtgcacaatgtgcagtttatttaaatgtattgactgttttttagtcactacacaaatcatctaaaagaaaatacctcagatgaaacctgcagatccactaactagttatcagtttatcaagactgatcgtgtccactcccttcagaaatcacatggatttgtgcattatgcagatcttttttggtcttccccatcttttcccatcctgaactagaagtagaagcctattgcatttttatctggtactttcttttgcatttagtagaaatacatacacatactacccgaggctactccgcagtacattaaaatttccttttgctttccagtaatttcaaatatctcaactaaatatctcagttgaaaaatcaaagttttaattcttatccatctttcaacataaaaacttttaatattgattataatgtgttgcctgcacttttgttttttttttgttttgttttgagacggagtttcactgtgttgcccaggctggaatgcagtggctagatctcagctcattgaaatgtcccgagtttaagcaattctcctgccttagcctcctcagtagctgggattacaggcaagcaccaccatgccctgctaatttttgtatttttagtagagatggggtttcaccatgttggccaggctggtctcaaactcctgacctcaggtgatcctcccgtctcgggcttccaaagtgctggggttacaggcgtgagccaccctgtctggcccagcactcttaatagatatataaatcttactctattaattgaactaagaacatctttataattttccaaatatcatttataattattaaatattaaaacacatttattctgcttagcaaactttgcatctcctcagaatgcctaaatattttgccatatgaaggttccagtggaagtttcagacaatacattttgatggcaaatggtgaattttcctattgagaaatatgttgattacaagaaataagagagacagtagattttcaaaaccttttcaaactatttcagatgaatattcagaattattttacttatagattgcactcttctaaggcacttacatattctgacaactatgtgtttttgaagcaaattttgactgaattaataaatgacagcacagatcaaaatttaaaaacttacaaaattctcaatagatttcacaattgtgcaaagtcccatgctttcttttaatattgtatacttactatacttttaaggggtactttttaacagttgatttattatcaaataaactttctataatttgacagaacaacataaattcttgtttttctcctttctacctagaacatacatatgatagttgagaaagacacatattctgatcatgaagaaataaacacaagttaaatatgactaagcagaaagatggaaggaccaggaacggtgatgctaacttggaaccacgatgcaggctctaaactcctctacaatcatcctcccttgtgagaaaaatacgtaagtcacttttaaaataaatagaaacctgaacacacttcttagctggtttaagtattttaaaaacattgatgaattaaacacagaaatatggggaaatctcattacttaccttaaattttgaaattttctttacagatcatgagttacttaatgctctttcactcctgagtttacattgtaaattaaagttatgtcagctttaaaaaataaccaattaaaaatgatctaaatttatactttaattttaacgaatagtattatctcttattatttacctctgataaagtccaaatgtttgtaggcctatagctctggttatatacaatgaaatatctttctcatgagtgtagaatatctagattatatttaatgcatttactttttgaggaaaaggaaacccttaataaaatagcttcaaatatttggttttaaaaaatgagaaaacaaatacattacaggacttttggatttatcaccaacatgtgaagggctcagaagttgtcattcctggccttacaataataataataataaaagctatacaaattgaaaatcaatgacatttccacagtgggagacatattttatttaggagacagcagtctatttagtttttgagagcttaatcgatagatagttcaggttttctagtgaaccaaaatctaaatgcctacccattggttttggtagccaacatcaatatccaactgctctttcacacaacatgacttcaaaggctatgtaactaacatcatgtcactgcacctatgtctttttaaagccaagtacctctagtgcccctcattatagctcatatttcaaggttttctgttcctgcattagtttgctgaggataatggctttcagctccatccatgtccctgcaaaggacttgatctcatttccttttatggctgcatagtattccatgttgtatatgtaccacattttatttacccagtctatcattgatgggcatttgggttgatttcatgtattagctattgtgaatagtgctgcaatgaacacacacatgcatgtatctttataataaaatgatttatattcctttgggtacatacctagtaatgggattgctgggtcaaatggtatttctggttctaggacttcgaggaattgccacagtcttccacaatagttgaactaatttacattcctaccaacagtgtaaaagcattcctatttctctgcagcctcaacagtatcagttgtttcttgactttttaataatcaccattctgactagtgtgagatggtatctcattgtggttttgatttgcatttctctaatgattagtgatgttgaactttttttttgcatgtttgttggccacataaatgtcttcttttgagaagtgcctgttcatgtcctttgcccactgtttaataggattgtctgtttttttcttgtaaatttgtttaagttccctgtaaattctggatattagacctttgtcggatggataaatagcaaatttttctcccattctgtaggttgtctgttcactgtgatgatagtttcttttgctgagcagaagctctttagtttaattagaccccatttgttaatttctgcttttgttgctattgtttttggcatttttgtcatgaaatctttgcctatgcctatgtcctgaatggtattgcctagattttcttctagggtttttatagttttggattttacacttaagtctttaacctatcttgagctaatttttgtataacgtgtaaggaagggggtccagtttcaattttctgcatatggctaaagttcttccatagttcttccagcaccattaattaaatagaaaatcctttccccattacttgtgtttgtcaggtttgttgaagatcagatggttgtagctgtgtggtcttatttctgagttctcaattctgttctattggtctatgagtctgtttttgcaccaccactatgctgttttgtttacatgctggtttggtagccttgtagtgtagtttgaagtaaggtagcatgatccccccagctttgctatttttgcttaatattatcttggctctacagactcttttttgtccatatgaattttaaaacagattattctaattctgtgaaaaatgtcaatgttagtataaggggaatagcattgaatctataaattactttgggtagtatggccattttaatcatattggttctttctatcacttcccttcttagctgtattcctaggtattttattctctgtaacaattgtggaattggagttctttcatgatttggctctctgcttgtctgttgttagtgtgcaggaatccttgtgattttcacacattgattttttatcctgagattttgctgacaatggggttgagacaatggggttttctagataaaggatcatgtcatctgcagagacaatttggcttcctctcttcctatttgaataccatttgtttctttctcttgcttaattgttctggccagaacttccaataatatgttgaataggagtggtaagaaagagcatccttgtcatgtgcctcttttcaatgaaaatgctcacagctttttcccattcagtatgatatgggttgttagtttgtcataaatggctcttaatattttgaggtatggtccttcaatacctagtttattgagagtttttaaaatgaagggatgttgaattttaacatgaagtgttgttgaaaggccttttctgcatctattgagataattatgaggtttttatctttagttctgtttatgtaatggattacatttattgatttgcatatgttgaaacagccttgtatcccggggatgaagccaacttgattgtggtggataagcttttggatgtgctgctggatttggcttgccagtattttattgaggatttttgcatcgatgttcatcagggatattggcctgaagttgtcttgttttgttgtatctctcccaggctttggtatcaggatgatgctggcctcataacatgaattagggaggagtctctcctcttcaatcatttggaatagtttcagaagaaatagcactggctcctctttgtacatctggtagaattccaccataattccatctggtcctggtctttcattggttggtaggctatatattactgccttaatttcagaacttgttattggtctattcagggattcaacttcttcctggttcaatcttgggagtttatgtgtccaggaatttatccatttcttctagattttctaatttatttgcatagaggtgtttatagtattctctgatggttgtttgtatttctgtaaactcagtgttcatatcccctttatcattttttattgtgtctatttgatcttctctcttttcttattagtgtagctaaaagtctattttgttaatttttttcaaaaaaacagttcctggatttgttgattttttgaagggtttttcctgtctcaatctcctttagttttgctctgatcttacttatttcttgccttctgctagctttggggtttgtttgttcttggttctctagttctttaaactgtgatgttaggatgttgacttgagatatttctgatgtggatatttagtgctatacatttcctcaatgctgttttagctgtatcccagagattctgggacattgtctctttgttctcattagtttcaaataacttcttgacttctgccttaatttcattttttacccagtagtcattcagaagcaggatgttacatttctatgtagttgtgtggttttgagtgagtttcttaattttgagttctaatttgattgtactgtggtctgagagactatcaagattttagttattttgcatttgcagaggagtgttttacttccaattatgtgatcgattttagagtaagtgccatgtagctccaagatgaatgtatattctgttgtttttgaatggagagttctgtagatacttatcaggtccacttgatctacagctgtttgagtcctgaatatccttgttaactttctgtcttgataatttgtctaatattgacagtggggtgttaaagtctcccactattattatgtgagagtctaaatgtctttgtagttctctaggaacttgttttatgaatctgggtcctctagaattgggtgcatgtgtatttaggatagttacctcttcttgatgaactgaatacttaaccattatgtaattcccttctttgtctttttttatctttgttgatttaaagcctgttttctcaaacactagaattgcaacccctccttttcctgctttccgtttgcttggtaaattttcctccatctctttattttgagcctatgtgtgtctttgcatatgagatggttcacctgaatacagcacactggtgggtcttgactatccagtttgccagtctttgtcttttaattgggacattcagtccatttacatttaaggttaatattcttatgtgtgaatttggtcctgtgattatgatgctatctggttattttgcagacttgttaatgttgttgcttcataatattattggtctgtgtactttactgtgtttttgtagtggccggtaatggtttttcccttccatattcagtgcttcctttaggagctcttgcaaggcagtcttggttgtgatgaattccctgagtatttgcttgtctgagaaggattttatttcttctttgctcatgaagcttagtttggccagatatgaaattctgagctggaaattcttttctttaagactgttgacatgaagtccttgcccatgcctatgtcctgaatggtaatgcctaggttttcttctagggtttttatggttttaggtctaacgtttaactctttaatccatcttgaattgatttttgtataaggtgtaaggaagggatccagtttcagctttctacatatggctagccagttttcccagcaccatttattaaatagggaatcctttccccattgcttgtttttgtcaggtttgtcaaagatcagatagttgtagatatgtggcgttatttctgagggctctgttctgttccattgatctatatatctgttttggtaccagtaccatgctgttttggttactgtagccttctagtatagtttgaagtcaggtagcgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgagattgattcttcctacccatgagcatggaatgttcttccatttgtttgtatcctcttttatttctttgagcagtagtttgtagttctccttgaagaggtccttcacatcccttgtaagttggattcctaggtattttattctctttgaagcagttgtgaatgggagttcactcatgatttgtctctctgtttgtctctttttggtgtataagaatgcttgtgatttttgtacattgattttgtatcctgagactttgctgaagttgctcatcagcttaaggagattttgggctgagacaatggggttttctagatatacaatcatgtcgtctgcaaacagagacaatttgacttcctcttttcctaattgaataccctttatttccttctcctgcctaattgccctggccagaacttccaaaactatgttgaataggagtggtgagagagggcatccctgtcttgtgccagttttcaaagggaatgcttccagtttttgcccattcagtatgatattggctgtgggtttgtcatagatagctcttattattttgaaatacatcccatcaatacctaatttattgaaagtttttagcatgaagggttgttgaattttgtcaaaggctttttctgcatctattgagataatcatgtggtttttgtctttggctctgtttatatgctggattacatttattgatttgcatatattgaaccagccttgcatcccagggatgaagcccacttgatcatggtggataagctttttgatgtgctgctggattcgttttgccagtattttattgaggatttttgcatcaatgttcatcaaggatattggtctaaaattatctttttttgttgtgtctctgcctggctttggtatcagaatgatgctggcctcataaaatgagttaaagcaatggaaacaaaagacaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcggaggacatgaacagacacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaagtggaaataccatttgacccagccattccattactgggtatatacccaaaggactataaatcatgctgctataaagacacatgcacacgtatgtttattgcggcattattcacaatagcaaagacttggaaccaactcaaatgtccaacaatgatagactggattcagaaaatgtggcacatatacatcatggaatactatgcagccataaaaaatgatgagttcatgtcctttgtagggacatggatgaaattggaaatcatcattctcagtaaactatcgcaagaacaaacaaccaaacactgcatattctcactcataggtgggaattgaacaatgagatcacatggacacaggaagggcaatatcacactctggggactgttgtggggtggggggaggggggagggatagcattgggagatatacctaatgctagatgatgagttagtgggtgcagcgcaccagcatggcacatgtatacatatgtaactaacctgaacaatgtgcacatgtaccctaaaacttaaagtataaaaaaaaaagactgttgaatattagcccccaatttcttctggcttatggggtttctgctgaggagtccactgttattctgatggacttccttttctaggtgacgtggctcttaacaattttccttcattttgaccttggagatactgacaattatgtgttttgggttgatcttctcatggatcttactgaagtcctctgaatttcctgaatttgaatgttggcctgtcttgctgggttggggaaattctcctgaatgatttcctgaagtatgttttccaacttggtttcattctcctcatttctttcaggtaccccaatcagttgtaggtttggtctttttacataattccatagttctctgattatttttcattccttttcagttttttctctaatcttatctgcctgtcttattccagcaagatagtctttgagctctgagattctttcctctgcttggtctattcagttatttatgcttgtggttgcattgtgaagttctggtgttgtgtttttcaggtccatcaggtcatttatgttcctctataaactggttattctggtttacagttcctataatgttttcatggttattagcgtctttgaattgttttagaatatactttagctcagcaaaatttgttattacccaccttctgaagaatacttctatcagttcatccacctcaagcctccacccagttctgtgcccttgctggagaggtgttgcaatcatttggaggagaagaggcattctggctttttgagttttcagcatttttgcattgattctttctcatcttcatgagcttatctatcttcgatctttgaggctgctgatctttggaaggggtttttgtggggccatttttgtggatgtttttgttgttgttgttttctgtttgtttgtttttctttcaacagtcagacccctcttccttagggctgccgcagtttgctgggggtccactccagaccctattcacttggtccctcccctacctggaggtgtcaccagtggaagctgcagaacagcaaggatggctgcctgctccttcttttttgagctccatcccagaggggcactgatgtgatgccagcaggaacactcctgtataaggtgcctggagacccctgttggtggtctcaatcagttagggagtatgtacaggatcggggaccacttaacaaagcactctggctgccccttggcagagagggtgcactgcactggagggaatctcccttgtccagaatgtccagacccttcagagccagcaggcaggaaagactaagtctgctgaaccgcagagactgtggctgtccctccccacaggagttctgcccaggaagatcagagttctgtccataaacctctggctggagttggtgaaattcccacaagggggccccacccaatgagtagggatggatccaggttccacctaaaaaagcagtctggccatgatctgccacagctgctgtgctcccggtctaaacctccctgtctccccagcaccaccaggggaaaacagccaactgatgccacagtgatagcaaccaccccttcccctgggaactcagtcatcttagacagtctccagtctgctgtcactggccacagcctgagcggtgatgagagtctgcacagctctgtgcttggcacccaaggccctggtggtgtggactcacaaggggatctcttgatctgtgagttgcacagatccatggaaaaagcatggttcctcaggaaagggagcacaatcactcactgcctcccttgactgggggtgggagtgccccttgccccatgcagctcccaagtgaggcattgctccaccctgcttttccttgctccctgtgggtcaggccaatcaccttgtcactcccagtgagagaatctggatacctcagatgaaggtgcagaattcactcgccatttttgttcttctagatgggagtcacagaccacagctgcttctaattggccatcttggcacctcctcatttaaccttcttttctcatctaaaggggataaaggatgaaactgtcccaaagaaaagtttataaaccaattaagggagaaaataaaattcaactaggcttgcagaataatcagtggcaatcatgaaatccacttcccaatttggcctacttccttgtagctagttacttcttactcccccaagatagtgtagcccttgtcacaagaatgtgttccttttcttttctatagataagatctaaggcacatgagatgatatgctttctgtttgagtttctcctttatgttacgcatactgataaaattgttgatgccagttgatctgaaggtcccagcaaggagccgactcacagaagaatgcagttttcacatcatgatgatttaatcttccttgacctgagcaattgacaaccccaattctccagaacctcacccgccacaatccccttaaaaaccctggcccagaacccctcaagcagacagatgtgaagcttgaggattccttcatctctttgcccaatggcattgtgattattaaactctttttctgctgcaaattatgatgtctcagtgtattggtctattgctgctcagtgggcatatgaatctggcagtcctgtaatagggacaaaagataaactactggcaaaacactcgtaaaagtcataacctaagacataggcccactgaaaggcggatattcaatcagagcactgtagaacatatttctctgctcataccataaaatttaaaccaacatgactccaatataaggagacagacaaaagagctataagaaacagacactgtttgaagatgagtacttaaggaaacctaaagttaagggaggagacaaaaacaaggacactagaggaatttgaaaccttcagaaacttgagctataacaaatattaaatgcagttcaactccaagacagattaacatatatcctcaattaactttatctcagtatcaatttatctcagcatcaatttatctcaatatctattatggataccacatgtctggctctcaacaatggcaacaaaattacaaaacatggtaaaaggcaagaaaaaaattaacaatctgaagagacaggatgatcatcagaacaagactcagtgatgatgatgcatattttggaaatagcaatcaagaaatttacataactatgattaagatgttaaggacactagtggaaaatgtagaaaatattcaataaaagatgattagtataagcagagagatgaaaattctaacaaagaaccaaaataaaaggctagaaattaaaataacgccaatagatttttttaaaatgctttcaatggtttcattagtagaccagacatgtttggggaaagaattggtgaaactaaagataggtcaaaaatacattttaaaacaaagtgccaagaaaaaataaacggaaaaaaaaagtgaaggacatcaaagacccgctgggcagtttctaaagttgtacaaaatgggaaactggaatagcagaaagacaagaaagagagaaatgaggagaatctatctaaatgagtaatggtcaagaaattttaaaacataatgacatgaaacaaacaaccggtccaggaagctcagagaatacaattcatgacaaacaacaaaaatacagcaccagacatagcatttcctatatgtagaataaaataaaataaaataaatcaataaatagacaaagagaaaatcttgacagaatctggaatgaaaactacattccttgtagagaaaaaagagcaaggatttcagcccacttccagtaagaaaccaggcaagaaagaagagagttgcgggaaatgtttaggaataaatgcaccaacttagaattctacatctagcaaaattatacttcaaaagcagaggggaaatcagaatttaccagacaataaaacactaacggaatatattgccagaaaactttcctgcaaatgtgttaaaagaggttattcatggaggagaagagtgatatagatcagaaacctgtatttacaataagaaagcaagtatgttgaaaaaggaaaaaaaattttttatttttcttattgtaaatctttttaaactacatgtttgtttaaagtaatattagtaaatgttttgggcaattacaggatgtgggtaagtgaaatgcctgatggttatgttacaaaagatatgaaggatgaactgggactattctattaacgtgtccagaattggtgggttcttggtctcactgacttcaagaatgaagctgcagaccctagtggtgagtgttacagttcttaaagatggtgtgtccggaatttgttctgacgttcagacgtgttcggagtttcttccttctggtgggtttgtggtcttgctggcttcaggagtgaagctgcagaccttcgcggtgagtgttacagctcttaaggcagcacgtctggagttattcattcctctcagtgggttcctggtctcaccggcctcaggagtgaagctgcagaccttcccggtggttgtcacagctcataaaggcagtgtggacccaaagagtgtgcagcaagatttactgcaaacagcaaaaacacaaaccctccacaccacggaaacggacccaagccggttatcactgtcccttgtggcagcctgcttttattccctcacctgaccccacccacatcctgctgattggtccattttgcagagagctgattggcctgttttgacagggtgctgattggtgcgtttacaaaccttgagctagacacagagtgctgattggcgcatatacaatcctccagctagacacaaaagttctccaagaccccacctcactggggagcccagctggcttgcctagcagatccggcgctggggccgctgggggagctgcccgccagtcccacgccaggtgcctgcactagtcagcccttgggtggttgatgggaccaggcgccacgaagcagggggcagtgccgttggggagactcccgctggccgctgggagcccacgggggaaggcgcgggcggggaaaggctcgggcatggcgggctgcaggtcccgggccctgccccacagcgaggcggctgaggcctggcaagaattcgagcctagagcgggcgggctggcagtgatgcggaactcagcgcatactccgcagcggctggccctgggtgctaagcccctcactgcccagggcctgtggcaccagcctgaccgctctgagtgcagggccgcccccgcgtgtgccgcgcgcagcctcagttcccgcctgtgcctctccctccacacctccccgcaagcagagggagcatgctccggccttggccagcccacagacgggctcccacagtgcagcggtggggcgaagggctcctcaagcgcggccagagtggacgtccaggccgaggagacacggagagcgagcaagggctgccagcacgctgtaacttcttattaaggtacctgcactatatgtgaactggtggagtgctatttgaaggtgatcttagattagtaacaaatgtgtattggatactctggggaaccactagaatagttgaaaaagaaagcatgctttacatgtaatgagtgacattaggtttgataatggatttttagatataatattaatacgaaaagttctagctacaaaagaaaaaatgatgttagagtttgttaaatttaaaatggaattttctgctctgtgaaagactccagagagttaaaagacaagccacaaactagaagaaaatatctgtaaaccatatatctaataaagtattggtatctaaacatacaaataactctgaaaactgaataataagaaagcaaacaaaccaattacaaatgtgcatagaatctgaaaagacacctcacccctgcccccgaaatacccatggcaactggcatataaaaatatgctcagtatttttttttctttagagaaacacaaattaaaacaattgtgatactaccacacattagttaaaatggcttaaatccatgaaccgaagtattacaaattctggtgaaaatgtagagcaatagtagctgtttgctgaagggaattttaaaaatggtactgcacgctggaagacagattggcagtttcttacaaatctaaatatcgtctcaccacgtacttcagctatcattcttctaggtatttatcccaatgatgtgacaatttatatcacataaaaatgtgagtgtttatcagagttcttttttataattatcaaaaatggacagcaacctacatggccttaaaccttaagtaagtgaattgatatactggtacatccagaaaaaagaaataaatataaatctacaggaataaatacatgaatattcaatatttattgctctgtgaaagaaattggtcagcaaatgcctcgtattatatattgctaaatatatgacatggtaaaaaaggcaaaacaatatagtataaaagattagtgcttccagaggtgaggggagaggaagtagggttaaatatgtgaaacatgaaaacaaattttttactgtactgaaactattttatatgatattgtaatggtggacataacattatgcatttctcaaaatccataagagtttttgagcttgaggaggaaacattaatttatataactttaaaaaaaactatcctttaggaagtagagggattgcaagatggaatgcagagtgtgacaaaatattataactgtattgaaaatatatgaaacaacctcactgagatgggtgggaaaaaatgcgttgaaataagtaatttcagaaatgagaggagactgtaaaattaaaggtgaaaggaagtgtatacaagcacagtgctccagttaataaagttgtttctcatggaagtatggtgtaacgtttctgacatcaccgtatatgtacactgtgaatgaacaattaagaaagtgagtgatgaatggtggccgggaacaagtagagggttattcttgatattctcctcaaatttctttaattaattagtaaatgaattagcaagtccctaatggcctttagagtctgctgaaggagatgaataaacagctgactattaatatagcataatataatatagtgtttaatataaacaaagggctatgtgagtgtggaccaagagactattattttcaccttttatctaaaaccttgaaaaagttggcacttctaccttaccttagatagtaagcaagagttagataagttgaaatgacacatttttcatgcagaaaatattacacacgaagacatggaggttcaaaatttccaggttatagggaaattgcaggatgctgaaaaatgcaggttgctgaaaggaatgcagtatgatgcaagatatttgatgttgggcaaaaataattttaacttctattatacagtctgtagagaatgggcaacattgaggggtaacagaagcctttgttactccatctttgaaaaataaataataataattatcccatttagatattaaagattaaataggttagtgaattcaaagtatgccatataaattctggcaaataatatgttcaaaataaattgtaactttgattattaaaacatatgtatacacacacgtacatatatatgtatgtgtatatgtatgtgtatgtgtgtgtgtataacagaattaattgtatatcatagttgaagtaaaagaatgggaagaaaaaatactttaatgggcctccaaataggacaagactatatacatatagtcttgcatatatatatatatatatatacacacacacatctaaataaaatgtatcaatacacacacacacacatattctcagtacatggggataatcagaaagatggctacaaaaatacaaccctcttagttttatataaccctttataaatatataaaactaagagaagaaagaatgccttctgaagcactgtaaactaacctaaggggggtaaagtcagaggattttactatgttggaactgaatttattaacatagttatagaaagagtctgtcaatgaaaggagaattagttgcctatggaaactgagctacagatgaatctttaaggcataaatctcttttccacctaagtggaagtccaattcctgaggcaggaagtctgggcaagtgaaattgccagttaagttggtaagccttcctacaataaaaataaatgcatgtgcacatttatattagcttgatggtgttaaatattctaatcattgaactttatttttctgatctaatacatacccagctatcatgtgactacattttgttttcccatacagatgtgcgtttgggtggaaagtatgtactgtttatgctgaagtaagaattttattttatataacatagttcttgttataaattaataaactaacattctgattgtttatagtcattgtgtgttgaatcgagtctccaaaatgaaatactaatcccaatacttgtgaatgtgaccttatttggaaataggttattgcagatgttattttgaaacagggtcatattgaaatgggatgggccctaattcaatgactggtttctttataaagaaagaaaatatggacacagagagacataaagaaatataaggaagaaggccatgtaatgacagaggcagacagtggggtgatgcatgcacaagtcaaggaacaccaaaaattgctggcaaccaccagaaactagaagacacatgtggaacggactttaagtcagaacttttcagaaggaaacaatcttgccaacaccttgatttcaggcttctagcttacagagctgtgagacaacaaatgttttttttttttttttaagccacctatattgtgatactttattatggcagccctagaaagctaatacaatagtcaaagggaaataaattatctccctgtagcctaaaactttaaaataatttttttttcccagaggccttttctttcatttgttggttttggtttctatacaatagatcaaacatcttcactaatagttttcttagacattatttttggaaacatttttaaaggactcatggaaatctataatctatgctgattgactacttccatgtaaagaatttgatatttttcatagttactactggctgttactgtgctattcctaattgtcttgaatgttgcgtatgtagcatgaaatcccaatttttattgaagtaggatatatatatatataactcttctatggttgtcttcaagccggagcctatttgttagcactgcagggcatcgtgtgtgtgtgtgtgtgtgtgtgtgtgtgtggtagaagctactatatgagaaatgtggagatacgcctttagttcaattctttagctgctaactaatttagagttcttactgttgttttagtcaggaaataatgaaatatatcatcaataaaaagttaaaggaacaaggtgaatcagtccaatgggagaatctaaatcttcccagggatctgtccaaatccataaaaagagtaccatttgataggtaacagcaggggattaaagactgaagcagtttgctgcaggctatgaatgacctgatcccttaatccatctgtctttttatatgagaatgttatgctaattagctgagtaaattgtttcctgatgatattaattttgtgcctttctgttattctaggctttgactttcactgtgataaaaatatacgaaggggcattttcaatttagatggttcctatcctgataaattccaacacagcaatgttgtgggggaaacatgtataaatagcaaacttaatcaatcccgaggatagacatagatgactttagcttcctatataatcattccctttagcttctaaagcattacattaacacacttgaaatgttaaaacataattcaaggagaattttaggaaatgcaattttcattgccccattttctttggagaaaatcaagacttgaattcattaacatggaggaagtaatggaacagatagtcgtgatgtgaaatcctgcaggtgttgtgttctgataatgcatatcctttacaagtttgggtaaattatttgctttgcatataaattaactccaaagctgaatcaacattagaataataaaaatgtagagaatatttttattccaaggaagcaaagatttatagcaaaatatatccaaatcctagatgcaatttcaggaggatagatttaaaaatatttatcatactccaaaaagaaaaaggagaaagaaaaaaggaaaaatacatacaattgagagaaaggaggaatggttttggaaaatacaatattatgttattattgttacattagggagaaaataattgagaatcgatacatttgtttttcagtataaaaacaaaaagatggcacttatttaacaattcttaagtgatgtcttctgagttccactttattgggtatgtattgttcctaagctaaaatctaatttcaaaatattacgtattacaggtgtagtgttgtcttggtctgtgttgtgttgctgtaacaacacttgagactgggtaatttataaagaaaaaaaggtttatttagcttatggttctggtggctggaaagtccaagactatggcattggcatctgttgagcttctgatgagagccacatgctatgtcacagcaaggcagagaaacaaaatggaaatcaggcaaatcattgctttataaaagaggcaactttctttagaatgaccggctcttatgagaactaatccattatcatgaaaaataacccagtttcaccagaaagttattaatttgtcttaatgacctaatcacctcttcaaagcacgatctcctaacaccttacatgggaaattaaatttcgacatgaattttggagagaataacccatgtccaaactatagcaagggtaaagaccccaaatttacttagacatggggattaataatcatgtgtcattgccaataaacgttttctttcttttgcacttccaaagaattttttcaccacctattttcctctatgtttttctttctctagtatttctttctctaaaaatttgtgcttgtgtaaataatttgcaaatgcaacttttttcttctttgaaatgatagctaaattcaaattacttttatcttattcaaaattcagagaaaaattcagaagtgacctattagatgtttgagaatgtgctatactacatcaggtgcacaagttcctgtgaataagaagcaaaaaagctagcactttccccacttctgtttttaaagaataagcttatcaatggatattgaggaaaaaaactactggtaatatttaaatggtaaaatgggtatggtaaaataatattacgagcattttttcaagtaatacattttgaactttaagttttcttctgttaattttatctgtttataggagtaatcctgttttgttcacttcagtatattcactattcctttcccttacagtcaagcattggacatggccttgatattgctggtgattacccatagggctcaatgttcatcttttgtttctaaattccaaaagcaaagttgattctaaaggatgataataatcattaataattcatagaatacctatctccaaaacagaatcaggaatgctatagacaataataagcacacattaaaccaactgggcactgtgcccagaagatcagccaagtacacacaataggcaagaaaagagcttgtatgtgtgtaaggagaaataagaaagggaaagcaacgcgtaaaaggcttccaaacagaacaaccagggagtcaacagattttcaaactttcacagaaaccagaaatattttgaagtcatttctgctgggtctactaactgtcttacaatgtaagatagccatgaaccccaatggaagaagtagaagcaaattgagtatattctaaaaaattcaaaatttgtaggcatattaagttttaggttttacaagcttacaagtggtgaattacaagaccacaatataggtgtaggtttatgggcttttttatttgtgatgatgacttaaaccaaccttcttttttctatatgatttgttgaaattaaagcactgtacatgtgattatgacaaggaacaaggagtctcatgtatatgttttcttatattataaaacagcacctgaactttttcatgtcagatctctgctggcaaattaaaggaggaaaatacccccatgaactgaagaaacctatggaagttagcttattgaaatgctgccagagtcttcatttagaggggtttttataggtagtaggtctaaaggatactagcaaacaaaaaatgctaacaacattttttttcccaagggagaagtaccccaccaaatttattccatgtaggcctgagggttggatactaatttacttaccatgtatttattataaaacactacttaggcaggtgtgaccaagctataattggcaagaaaccagggatgtacatttgcttttgttattatagctaaactagaagaagactaaatcctttaataggaataaaaagttaacacaatgatttaatttagttctacttagtatagataacatttggtagagcttcaggaacttactatatattttagcccttaatttgtaatgaaggcattgacagtataaatcttgggataaactaggtaaataaattactttttttgaatatgaatgttcttttttatttatcctggagtcatattcagtgaagtgagaaatgcattttgttaaactgacacctagatttcagggagaatatactcaaatgataaaatatttatatcaagaaaataacttttactccatgacattatattatttatcagatatgagtgtcattaaaattcattttcaaactgtgtaaaagagaatgattcctatgccaatgttttcttacagtgtgaaatcttatattgataaaagtacaatatttatatatgaaattttggaaagctttgagcataaagttctcagtcacatcataacattttctctgacagtgtgtgtgtcttagggtagggaaagagagtggttgaatgtccatatcttactaactaagatggtatgcccactgtcttaacaatttacttcctgtattgactcgactaattaggctgccataactttatttcttaattgttaatatgttggggaaattatcaataagtatagaaaatgacaaagttattgtttctgaaaaactatgaaaaagaggatagccttacttatgcagagcctattaaaaagagagtactttttcttcttaaaatgcatagcttgaccagctccatttaacactgttttttaaaagatgtgttaatatcctaatggtataaatgaattcagtcatgactagttgagtcaaagagatttaaaaattatttgaactgttttatcaaatttctagctcattgtttagtgctagatattcacaaaacaaatagttaagttcctaagattattgttgcaaactgtgggaactaaaagtctttaattacattactttgaaagcaaaaagtgatttccatgcaaaatattttaaaggatttctacccaatgtcaaattttctcatctattcatttaataagaattgattaaatatctgttgtgtcttaaaaatcaatgacgaataacatcctaaacttcagcaagcatatggttgaacactaaataaagaacaaaaaccaaggtaattacagtagagtgtttcagtgatatattaccaccaagaacagagagctataaaaatcactggaagaacaactaactgaatctttggggagtgaagaaaagctttctttggaaaataacctctaatctcatatctaaaggaccagtaggagttatccataaaaaggagaaagaaaattccaggtagttgaaatggcttgctgaattgcaagggcacagattactaaaatgtttagtaatactcatggtaattttgtttatatttttgaaacagatatcatgtagtcaacacaataggtcaaatcaggacctttggtacacataaccctttttctgtaaggtgttgataggtatcatttgaataaaattggtgatatttagtgtttattggtgtttgggaaaaacatgtgcttcctaaaattttagcatattttcctatatgatttctcattaataaattaatgcacaaagcaaatatccaggaggtgttaatagtaagcagtaatttccaaaattgcatgaccaagaaactttttactcatagaataactgaaatacttttctcaggaatatactttgagaaatattgcttaaatacatgtggaaaaaaagtgttctaaatccaagttctttatgatggagattactgaatccaagtgttctaaatccaagttctttatggtggagattactgaaaaagtatgggagaaaattatacattttgatagaaaatcgtaagagttgaatggtgtttgcccaaaaggtttgtccacccagaatctcacagtctgacctcaatcgtaataagcatctttgaagatgtaataaggtaataaagtgtgctcatcctctattacaataaattctaaatctaatgagtgtccttataagagatagaataacagaaagacacagaaaaagcggggaggcatgtgaagacagagtcagagagactggaaagacaaaaaccgctaagaattgctgacagcatggaatgggttttttctgggtctccagtggaaaccaatactgccaacacattcatttgtcttctggcctccagacctgtgagagaatcaatttctgttgctttaagtcatcaagtttgttgtaatttgttatgacaaccctggaaacctaatacaacaatgtgatgctttagaaccagttgtgttcgaacaaatttaagccttaactcatattcttaccaaacagtccccaatgaattatggatgtcctttgatttcatgtccttgcattatcctcccaaccagacaatagattagccttgtgaattagttgagccatgagaatgcagctaaagagacactgtataagtttcagtcctaggcttaaggaagctttatagcttttgtttactctgtcttttaccttgagccactgtgcaaagatgtctaggttagcgtccttgtggatgagacaccttatgatgaaaaagaccaggaggaatgaaagactgggaagatagagaggaagacccagttagtttctagtcattccagcacaacatatgaatggggccagctaggatcctccagtccctatggagctgcctctaaatacaaacatattaaatagtccagcagaagacaccatctagggaagagatgagccacccagctgagttcagcccagattgaagaatcatgagcaggtccatctgtgctacttagctgttttaagctgctatgtttagactggtttattatgcagcaatagaaagctgtaaccatctaatatgattatcaagtatgtgtttttaaaacaaagacaaaaaagatgaacagatataagattaggttgtgtgctgtagcaaaggtggatttgacctttttttaagttaagaattttgataatctaccatacatttttaaattctttcttgcattaactttatctctggataaaaaattcaggccacccgtaagtaaatagaaacagtaggcataaatacacaaaaggaaagttatattaaaattctgcagaaatgtaacaagaataaaaaagctgaactggatttttaggatgttctacactcagcttttatgagaaacagacaaatgacaatctcatgccaaggatttgttttaaaaggctgtataacaggtagaccattgactaacacatgttttaccacctttatcttcagagtactgcagacaaatgatattcataatgactctacacgatactgaaatggtatctgaatattaacaactaaattctgaccagttatgatttaaaacatttagctatttattgattgttatttttttaaaaacttggaatgtgcattatatgtatatttaactataaagtcactgaacatttaattaacatatgtcctgtttttcaatcattactaggagtaatctttatagaaatacaagtagcaaccattaccacaaatgaattctcataagaaacagttattcaagtctttttctctctctctttgtcaaacgcatgtgcacacacacacacacacacactttgtatgcctgtggattgtgtgagagagagaatgagcctgtaaatacagaattatatcagaattcttgtagcaaataagctatcaggaaaattgagccaacttagtcttggtcttgtgaaggacattttctcttttctgacctagtcttttctattaagtgaaagatgtcacacaatgaccactcatctatttttgatggatacatgaattgtacattacatggaaagaagagagaaaataatcctaattttatataatgtacaggttagaaagcctgatacagactaatataaaattaatgctttgaataaatttgtttatactattgctctgttagtgttgctacttttggtttgtttttcaattgtttttccaatatgtatttagtttgatttttaataatcttctctctctcttttttcttttcttctcctttacctcttgctcctcttccttactctccttgccttcctcctcagtctcctcatcctcatcttcctcctcatcctctttctttgttttcattacaaaataaaataagcaatcagaaaagttcatacagatattgttacttatctttagggacctggatctaacttagtgctgttgcttctgtttcttcccttttgtcctcctcttctttttctcctttgtgttctgttttactttttaaaaatagatgccacaactctgatttttaatctgattgtgtaaatgatccttaatagtaaaatcaattttaatatcttataaaacagaagcacagcaaagcattttgcagaatttaccataaagtaaataataaccattcctagtatgataatgctgcagcaatttttctttcatcctctgcaacatttttatctgacacagtctctgctgtttccaagttcaacgtcctgcagcaagccttgccagcaatacagaatactttcaattagtagttctctacttctctggtcgctaagcaactgacctgtggtgaagaatacataatgatctgcatagacaccttagagcaatagaaagtataagcttcacaagtttcatttgctctcttgtgttgatgttacaataaccagttaaatgcatggaaatatttgatagtagtttgctataataaactttaataaagattaaaagaagccttggagaaaggtagaaataaacacaacataaaatattgtatttgtcatttgttcatgtatgtcattttattgtttatagggagggcaagcaatcaggttaatattttattaaatgtttatattctagctactgtttaagacagaattcatcaagtagcagaagtgatggaagggccaaggggaagaaagatggacaaaacctgaaaattgaaagtgcaataaaatgaaaattacaaatgaaaaccagtatgcctgagttatacatgactgtttagtagagtgtcttcatgtgggttaaagaagaaaaggaaataccagctggaatcagcagaacagatttagcacttgacccttggatacttttcattctatttatctatcatatttttattggtttgtattccattgactactatatgcaccgaccctcagcaaattcattcaatagagaggagagattatatctccactgtatcagtggagctgcttaggaacatttctcccgcttcttgcatgtattttgtcctatttgtacattgtattttatgagctgctttagaatagtagaataactttcctttatatggtatagaacttttgatatatctcaaataaatttttaaaaaatgatcaattgaaatgtatgttctcatactgtatgtgcaaatatcagtagtacaaacactaaggattaatgaaaatgaaaatcctaatatattaaacttagaaaaatagactaaatatttactgaaaagaaacagataaccaaaatttcgtgatacacaatgaaaagccttgagacattaaagaggactttcactgcctttgatgatgtcatcctttacctattaagttcttctagcatggtaactagaactaaacttttaacttccttttaaaccacacactgaatgcatctgtgaaaaagacctgcatactacaaggtaactttaattacatatcttctgtggggtccgtgcttttagtttagtataggtttatgcaaagtgatactattggtaatgtgtaatttaaacacacacacaaactaacaggccctgccgcctatcaatgtctgggtgatatcagagaaggccgtgtgggaatctagaactttcttctctgccaggtagttacaatgtgccccgtccttctccaccagattccttaggtgtcaaagtaaactaagtgagaagttggaactttcaccatcatctagtggtaaaaaggtccaaggcctcctgatgtttgccttcccttcagtgtaggccatagtgggagcagaaacaagaaaaaaatcccccactctccaaaggtggttgagcagggataaatttttatcaccacctagcaataacaaggcacccccactttcaccatgtgtggtgtcacaggaggtttatttccaagagttaaaatacagagcctcatagcataatatccaaattaccctagatacgttgaaaattactcagcatatcaagcaccagaaaaaaaatctcatcttgaatgagataacacatgccaacacagtgataacacataaattagatttattcacaaggattttaaagccaccaccataaaaatgttttaatgagcaattgcgaatatgctggaacaaatgaaacaatggaaagctttacaaagaaatagaagatgccaagagacaaatagaaattttggcaccgaaaaatataattgaaactttaaaaaatacttgatggctcaatagggtaatggaggaaatagagaaaagaataagtgaacttgaaaataggacattaaaaatttactaatccaaagaccagagggagtatagactgaaaatgaaaaaaaaaaaaagaacagagcctcaaggacctataagactatagcaaaaaatctactattcatgtcatcagagtcctagaaggaaaggcaaaagtgggttgggctaaaaatatatttgaaaaaataatgtccaaaacgttttcgagtttggcaaaagacatacaactacagattcaagaaatgagaaaatctaaaacgggacagatacaaaaaaatcaacaaagaaacaggtcaatttcagaaaacagcagaagaaaaaatcttggaaacagtgaggtaaaacaatgcttcatctctccagaagaaaaacaatttgaatgacaatgatttcctgtcagaaataatggtggccaaaaggaagtgatatatttctcaagtactgcaaaacaagaactgtcaatccagaattctgtattaggcaaaaatgtcctttagaaatgaaggagaattaaataaattctcagaagaagaaaaattaagaattggttgcaaacagacctaccctaaagaaaagcaaaaagttcttgaaacataaaatgaataaggggcctgaaatcatcagaaaaatgtaagagtaacagaaagagcaaaaatatgaataagtacaacagatttttcttcttgagttttctaaattatgtttgacttttgaatcaaaaactgtaacatcgaaatggttatcaatacctaaatgaaaaatttttaaaattatataaacaaggatgggtaaagagacttccaacgagataagatttttacacttcactagaagtgttagatattttgatagtggtagtggtcacaagaatttacacatgtaataaaatgacagatgtatgcatacacattttttcaatgtcaatttcttggttttaatgttttactgtagctacaaaaaaaatgtaaccactggggaaactaggtgaagagtatgagagacctctctgtactatatttgcagccttctgtaaatctataataatttcaaatcaacagttaaaaaataaaaatatatctaatagaccaatagtttcatatggagggcagaatgatttaaaaaaatgagatattttgtttatgcatacctgtaaaggcatccatgaaaggtattattaacatttgaaattatgtaagtccaatgctgcaggaacatgggcatactatagcttattttagatgctttagaaagccaaagtcatctctggtaagttctacattgatgataataacctgagagacttctcagtctccaaaattgcactatttctaaaatataagtaaatattcccttcatcctaaatctttcaaagtttaagaatgtcattgatagtcttcgctttagaggaaaatacagagatcaagaaaaaaggtctggaaaaatgaaaaaaataattttaaaagcttcctcagagagaaagagtttcagacggatatagtttaactatattaactcagccatgaatttcttacttctcttctagtaccggttactcttttgctgaatgaatctaccttatgaacacaagttaaaaaaaatgtacccatgataagtaaaacattattaaatacagctatttttataaaagtttcaagtcaaaaatggatccatttctgttcttcttcttacagggagttgcttatttcccatccttcattaaaagggccaaaaagtatactcatctgtagtagagaatatgcataatgtttattaactcatgcttattataatgttaacacattatctgccactccaagaatgtgggcatatttagaaaatgttcaatatggtatctataaattattctatggcagactttgatttaattcttttcatcttcatttaataacagtggagtggttcttaatatcatattttcattatttgcatgtcctttgcaagaaggcttgggaacctatttaccccaaaataagttccaaacaggtcagacttctaattgttcatacaaataactaaggattagaaatatagatgctatacaattctaatataaatcttttggtattaacccctcaccgttgaaaacacattaactgacttgtagtgtttgatcgtttccacacaaagaagatggatcactgtatgtctcttaatatctacatagccttaaaccagaagatagaacatgattgttcaggagagtcacatgatttcaatcaaattattgtaagtatgtcatttgagcagaaataacacaatgtgcagaatactgcaagtgaattttcttttcgccaaatagtgtgagctaaatcatgtttactatagtgataatattaattattcgatggatatgctagaattattctactgatcttatgttgttttctgaccacattttccaaaacactttaaattgtgctttaccctttcatacccttttattgtttactgattcattccacaaattaaaattaactattggtactaatgtgtactgaaacaaaaaacaataatgtcacttcagattgtgactgattcttaaaatattctccatggtcttcatggcctaatggttttaagttatacacacagtatttcacttaaaatattatggaaagcagcacctggagctttaaacaagttacttagtttatatctgtagtttataaatcatgatgtgttaaactttattatgatcttacaatttgaatttaattcttttataatgtctctaggtcctcctgatgatagatagatagatagatagatgatagatagatagatagatattttccttttagaaaacctcttgtttttctcatatcccactctctgacagcattatattcaagagcaagggtgggaaatgtgtttactgccaaggtattagatagctaggttaaatgccaaaattaaactgatataaaaagtaatacagaaacaagaaaaaaaagtggaaaatgaaaacataaccttgtaaagtttttattctaatatacaggtatgttaatgaaaataatagaatggtttctgaaagacataaatggacagtattgttttatgaatacatcagtaagaaaatactttaacaggaacgggaaattctccaggttcagtgtgagatttccacctataattttcatttggctggcgagactgacttgcgttacttgagttatgctattttaaaagtatttgtcaccagtatgtatcccttctttgatatttttcctcccttctacagtgacttttaaaatccaaatctaatcaagctgccactgaggacatattgttatattaaacatacaaatgtttaagccttattaaatacagactgggtttcagtaaatcagaaatggttaaacaaaacaaaacaaaaaaaaagaggccaggcgcggtggctcacgcctgtaatcccagaattttgggaggccgaggcgggcggatcacgaggtcaggagattgagaccatcgtggctaacatggtgaaaccccggctctactaaaaatacaaaaaaatagccaggcctggtggcgggcacctgtaatcccagctactctggaggctgaggcaggagaatggcgtgaacgcgggaggcagagcttgcagtaagcggagatcgcgccactgcactccagcctgggcgacagagcaagactccgtctcaaaaaaaaaaaaaaaaaaaaaaaaagtggatgaaaaatagtataaaaggaattactccctaattatttatattgtgctaaataaaattcccagttccaaaaccaaaatgtaatgactgcaccatttttcactttttctagatgtggtcagagactttaaatgagagaaatgatacatgcatatacttggagagtaataggtattgctgaataatataaagtttgagaatacacttttgcttaaaacgtaaaattggtgatttatattattttatttttaaatgtagaaatagctaaagtataaattttgtataatgcaagtgcttttcctaggttttagttttgttttaatttaggagtaagggtaaagaagctatttataaatagtactaagtccgtgtgttcttttctctaaatacatcttgatgtgttacgaagatcaaatgttctgaaaaagcaaatttcctctaaacctgagtcctctctttcactagcagagagaaaaagtctctgctaaagttactggatgaaaacagaaactgtatacttgactctattaaaggaaaaaataaaatgttttttataatattaagtcaacttgaaataaaagaaaaaagttagctattcaggcctgtccctaacatttgtggaagttcagaagtattgcaaatctagacccacatattaatgactacatatttataagacatcaatcaagcttaagaactgttaaagtgtattgaaattcctacattgacaacttcataacaacttaaaaaattaaattgaaatctgcattcttggactgccaagagaggtccacaatggaatgtgaggattggaaagaggccccaggtcatagccaatttcattctctttccacccctctttccatcttgctggatgaggggtttgttacatccaagatactgcagcctatttgtccagcatctcctcatgagacatccctttgaccaagggttgtacacaccagtccaccttcaaaaaggctgatgtagggaatggccttgaatagaccttgaaagcaatcttaggaccttttatttctcctaaagaggaatccagagtcttgagtattggtacattggcatagcacatggatgggcatgagtcttgtttcacatgagcacattcacttgttttgtggactcatcgccacttccccttctactctccttcccagcccccatgggaggaaggtgaaagtggtttgtggttcactctaaagggctggcctagaacctgagttcctcttccctttagtctaagtttagcactgcaactatcttgttccactgttcacatttaccacgaaatgggtcaaacatacaaagagagcctaaagacacttttaatacatattcgtaaatgaaagtttattaataaaattgaaggagacgtatcaacacatagtcacttcttttctagaaaacactccctactttatagaattgctatgtgtatagttcctcagtaagtgctatgtgtgaacagaagatgtagaatacagatcttttatcttcaggtcacttaatatccaagtctgaacataagaaacataaacacaaaaaagtaactttcagaaaagtgctatgcaatatatattggggatcttctaaggagggagatgccatcgtggactatgatgatcaaagaaaggttaatagagcttcctattatgtgatactcttcaacaatatggggaagaggaaaagtgcattatggattattcaaaagacaagtgcaaatttggtgataagcatagaaaacattcagaagtatagaatgcatacattagacagaataatgtgattgtttcagaatatttgaatatacaattagaagtaaatgttgggacaaattatgaaggatttagaatattagatgtgagaatttgaactttattcataaataatcaaaaaaagaaaatgattgtaaattgctcaaaaaagggctatccatcaaaaggagagtcagggaataacatgtattttgtgcattcaaaaaaaaaatcaaaagactgtcttccactttcaccttttaagtgtaagggtcacagaaggtaaagaaagtagaaataaatttgagaaatcattgaaaaaaagaatttaagtatatgagtaggcataggcaaaccaaggtaatgacaatgtctgtgaccacaaatttttgatcagtttgacaatagtacctttgacataaataggagaaacttgagtcaggaactttgtcctttactcatagcacctggcataagagctggagccagttttatgtttttgctagtttttgtttgttttctttatacataaaacaaagtgaaaaatgaaaatggccagaaaaaagttggaaatttgagactggatctcaggataggtattatgatgtatttttagtatactcatttacatagagatgatggtttacactattttgagaaaaagtaatggtttagatggaaagttaaaaatcaagaaaagaaataaagcattagacagaaacaaaaatattcaggataggttcatgttatagaagccttaaaaggacaggttgatagattttaaaaatattacagtaaataataatgttagaaagaaattgatcacaaatttctcaccaaacatgctatcacaatcagattacctcaaaccagaatgtaatcaaaaccattgcctctttctctaacaacaaagattactatttactactgctgtagcattttgataccttcaggtctataggaaaggaataaaacaccaaatgattctcagcacaaaaatggataatgaatatccatttattgttattaaaataatgggcatgattatgctaataggtaacattctttctttagtatgaaattgcattgtattgtgtctaagaaaaagtgttggttgtttttgcaaagtataattcaggagattaattgtattcaccaatccacagttttcactaatgagaagtgaactggaatttgaaagcacatacacttttccccttaaacaattgcccactccattttgcaagctgagaaatggagaaagagggatatcaatctaggtaaagtctgaggtgctacttgtattaacaggactcaggaatcaaaaatctgtacttcctcccataaaaaggggtgcgattttttcctgtagacagtgagttaatgtggctgccttcaaaggcaaacagacttcaatgtgactagaagaaaaggacaatggagtgtccccaaaagagaggcatgttttttaatgaatgaaaaaccagagatacttttcaaaataatagaataacatggcttagttattttcattacattacaatacatttagtagactgtcctgtccttcagaaataagagccacagtgaaatgacaataatacatagtaacactttactatgagcctaacactaaaaatattactttgtatttattgttttatttaattttcacaaaaatataatgcctgtactaccaatacacacttttgcagatgagaaaattgtatcagaagatgtaatgaaattcttcaactttacatacctaataactgctaagattggcatttgaatatactttgtctgattttagagattgtgaccttaaccactatgtcatacttccttcctgaagtgttactgattcacatagacacacaaatctgggcttggctaggttccttttcccaaagagagagatgggaaaatctactccttaaatggactatcaaaccaaactttagatatcttagtcacagaatactataagttagtatattttatttcttagtaggttattaatgaaaaattttaggaagaaacttaaagcataacaacacattgttacaatagggagttagagatgaaatatttttaataaaggaaggactatgtaatagtagccatatcaaggaggtcttttggaatggactagcatgagtctgcattagtacaggaggaaccacagaggattaacagcttaaagctgatagagaatatttgatgctagagataaaaggaattgattgaatttaaagttctagtggaaaagttagtctggacaatgggcactgaaaattcaagaatgggtgatttcaaatgtaggaaaatgtgagctaggatgatttataggtacataaaggagctctttatagatggtcactgatggtttcaataaaatagaaatgagttcatttgtcaagaataaagaaattgggaccattgggagcttaaggtgattaggcaaagcttggcatagatgctgacagaagtgtatcagaaacgtaacaggtccaatcttactgatctacctttattgattcatttgtttacttgttcattcactttttatttaacaaagaatttagtcataacattttatattatatttatgtatatatttaaattatatttatatttatttagctccccaccccacaacaggccccagtgtgtgatgttcccctgcctgtgtccatgtgttctcgtttttcaactcccacttatgagtgagaacatgcgatatttgtttttctgttcctgtgtatttttgctgagaatgatggtttcccacttcatctgtgtccccaggaaggacatgaactaatcctttttatggttgcatagtattccatggtgtatatgtttcacattttctttatccagtctgtcattgatgagcatttttgttggtcccaagtctttgctattgtgaatactgctgcgtaaacatacatgtgcatgtgtctttatagtagaatgatttataatcctgtgggtatatacccagtaaagggattcctgggtcaaatgatatatctggttctagatccttgaggaatcaccacattgtcttccacaatggttgaactaatatacattcccaccaacagtgtaaaagcgttcctatttctccacatcctctccagcatctgttgtttcctaactttttaatgatatccattctaactggcttatgccagatggcatctcattgtggttttttttaattatactttaagttttagggtatatgtgcacaacatgcaggtttgttacatatgtatacatgtgccatattggtgtgctgcgcccattaactcatcatttaacattaggtatatctcctaatgctatccctcgtccctccccccaccccacgacaggccccggtgtgtgatgctccccttcctgtgtccatgtgttctcattgttcaattcccacctatgagtgagaacatgcagtgtttgtttttttgtccttccgatagtttgctgagaatgatggtttccagcttcatccatgtccctacaaaggacatgaattcatcatttttatctcattgtggttttgatttgcatttctgtaaagcccagtgttgaatttttttcatgtgttttttggccacataaatgtcttcttttgagaagtgtctgttagtatgcttcgctcactttttgatgggattgttttttttcttcttgtaaatttgtttaagttccttgtagattctggatattagccctttgtcagatgggtagattgcaaaaattttctcccattctttaggttgcctgttcactctgatgatagtttcttttgctgtgcagaagctttttagtttaatcagatctcatttgtcaattttgattgttattgcttttggtgttttagtcatgaagtctttgcccatgtctatgtcctgaatggtattgactaggctttcttctagggttttaatgttttaggtcttatgtttaagtcttcaatgcagcttgagtcaatttttgtataaggtgttaaggaaggggtccagtttcagttttctgtatatggctagctagtttcccagcaccatttattaaatagggaatacttttcccattacttgtttttgtcaggtttgtcaaagatcagatggttgtagatgtgtggcattatttctgaggcctctgttctattccattggtctatatatccattttggtaccagtaccatgctgttttggttactgtagccttgcaggggttgcaaacctagtatctgataaaacagactttaaagcaacaaaagtgaaaaaagacaaagaagggcattacataatggtaaatggatcaatgcaacaaggagtgccaacgattatatatatatatatatatatatatatacccaatataggagcacccagattgataaagcaaattcttagagacctacaaagagacttagactcccacacaataatagtgggagactttaacacctcactgtcaatattagacagatcaagaagacagaaaattaacaaggatatttaggacttgaactcagctctggaccaagcatacctagtagacatttacagaactctccaccccaaatcaacagaatatgcattcttctcagtaccacatcacacttactctaaaatcgaccacataattggaagtaaaacactcctcagcaaatgcaaaagaatggaaataataacaaacagtctctcagaccacagtgcaatcaaattagaactcaggattaagaaactcactcaaaaccgcacaattacatggaaactgaacaagctgctcctgagtgactactgggtaaataatgaaattaaggcagaaagaaataagatctttgaaaacaatgagaacaaagacacaacataccagaatctctgggacacagctaaagcaatgtttagagggaaatttatagcactaagtgtccacaggagaaagcaggaaagatctaaagttgacaccctaacatcacaattaaaagaactagagaagcaagagcaaacaaattcaaaagctagcagaagacaagaaacaactaaaatcagagcagaactgaaggagatagagacatgaaaagtccttcaaaaaatcaatgaatccaggaggggtttttttgaacagatcaacaaaatagatagaccactacccagactaataaagaagaaaagagagaagactcaaatagacacaataaaaaatgataaaggggatatcactactgatcccccagaaatacaaactaccgtcagagaatactataaaaacctctacacaaataaactagaaaatctagaaaaaatttataaattcctggacacatccactctcccaagactaaaccaagaagaagtcaaatccctgaatagatcaataacaagttctgaaattgaggcagtaattatagcctaccaaccaaaaaaaaaggcccaggaccagacggattcacagccaaattctaccagaggtacaaagaggaactggtatcattccttctgaaattattccaaacaatagaaaaagaggtactcctccctaactcattttatgtagtcatcctctttttaaagtacattcttatcatgataaataaaataggaatttcttggtttattttatctaattattttatcttgccctaatctctaatctctatttttatttccttctgcttctccctcttacttcaattgcattcatgtgtttgtggtagacccttgaatatgcattttttgaaaactataaaattttgtggttgtttttgagttatatgttgtatatatagtttttacttttgtaaatccaacactatattattaagacctattattgttatcgtgtgtatctttacctcatttttttttcatgctgcacagcacactattacttcttcttctttttttttttttttgagatggagtctcgctctgttgcccaggctggagtgcagtggcgtgatctcggctcattgcaacctctgcctcccgtgttcaagcgattcttctgcctcagcctcccgagtacctggaactacaggcgcgtgtcaccacgcctggctaagttttgtatttttagtagagatggagtttcaccatattggacaggctggtctcaaactcctaaccttgtgatctgcccgcctcggcctcccaaagcactgtgattataggcatgagccaccacacctggcctgtattccatttttataaacaattgtgtgtgtgtgtattacagtgatagattctttgcctccttccaactccctgcaacaacaattgtctctactggatatcatatcctttcatgagtttaaacttaagtttatttgccatgtggatcaagagtaggactgctggttcataggtttggatttcatttcactccacattgctctctggatagttgcatcagtctgtactcccatcagcagtacatgtgaagtctagttttctaaatttaaaaaaaaatttgttattatttgaacattatcttccatctcactaatgagcactcctcaaatttaacccttctgctgtttataccatatatttaatccttcatttcaacagatatggttttcatactgaaaaaatattttatgattgctaatttcttcttcaggttcaaatattgtgccttatgtctttgagaacatttactatacatatttttggatttattttaacttttttttttcttcagagacagtgtctttcggttactcaggctggagcaagtgcagtggtgacagcctcctagctaactgcagccttgacctcctgggctcaagagattctcctgcctcagcctccttggtaactgggactacaagtgcatgccgccacacctaggtattttttttaattattatttattttgtagagacaggggctctcttggttgcccgagctgatctcaaactcctagcttcaagcaatgctcctgtcttggactcccaaagtgctgggattacagatgtaaaccaccacatatggtcacatattttaaactattgttaatttttgtaaatctggttgtctttgatatacatgtattttattttagagtcattgaattcctttgaggcctattttttcctagtaagatttattatgctgattaagaatacatggcactaaaatcaggctcaagattgacccaccagaagtgtttagaatgaaggactccttaggaaataactggattctgccaccctttgtttgccttcctcctccataaaagttggtgtattcacgtgtcctgggtggtgctgtttaccaagactggtctccctcagttttaatcaccatcctaacactcattgtatggagtagctgggttagaggagaatgcctagggttcagatggtctttctgcatttgtcactatttcctcattttccaagctaggttgagtcatattctgcctggccgactccaaaatggctttaaaggagttagcagtggtctcttttcaactctagttttgctagaatgggagctccatttggtcaaagttttgtctttctggctctgtagtgtattctcagtatttagaagagtgccttgcacactgtgggtactctaactattgaaagagcagaaaaaaatacaggaatgcaatgaaaaggaatgatgaccactaaaaacttccgccccagcatattctggtttccttacatctcagttttctgctctttgctgtcatttttttctctactcgcagactttactgtagtttgtaactgcaaaggtttctcacatcttttagtattagatgctgatttctgtgtcatttccagggttgtggtcacagaaagaagcccacatcatgttagttctccatcttaccagataaagcttagcttaatgtacttctatgccaatttctttgaataactaaactttcaataatttaatcaatcactgattaatccaagatttgtctcagatggggcacaacttccacaacctaatgtagcttccacaacctaatttttaatccccaaaaatgaaatttaccaattattttgttaaatcatacaaatataaaaattctgaacagtgaaataaagaaagtatctcaaaagtaagagtactcttggacaacaatagctaaaaaagtgtaacaaatatgaaaatatgcaggctctgtttctgacctttaatcattctatacttctggggagcagttattttgagactcagtttttacagaagtaaaatgggaacaaaaacagttcctctgcctggctcatagaatttctgtgagaataaaagacaattaatctttctaaagatatattacatatattgtaaagtaccacaattataaatacaggagaatacttgcttctcttcgtatccatttttctgtttccaatgcttgtttggtttttaaaatttaatagtattttcctgctactcaatgtttgactactgaaattcttatataaatgttttctgcaaaaaaattttatggacatagaataataattgtatgtgctcagttgcttgattaaaatactttattgtgattattttgtaaagaaaagaattgcactataatttcgatgttgtgcaaattataataattaaatatttaggctaaaaaagataatgcaagaaggctaagttgtattgtcatattgttaagattactttttatttaatgttcctaatcagaagtgaaccattatctatgtaaaaataatttaattcagaaaattttggtctcaaatttacataatgccatcattatcctttttatgttctggaaaatttattctaaattacctagaaaaaaaggttgattctatagtgttattttttattctctatatctcaggtaagaataaagggaaacgagtaagtaaaggaaaaacaaagatgaaaaaggaaattgtactcaagtcacatagacactgaagtctcagatgtatgtggaactttctgtttggtagaggatatagaaaagagaaagggatatcgaatttctgacaacctacgtgcttagtgctttgtctaccaatgtgatgaggacatatttattttttccttgtgctttctgcattgagacaagtacattataagcttatcatacaaatgattcaaaaaaaatactcgccatttattttctattagttctttttctcccgaggttactgccctacaaggagctattttaacctcctcctgtctttgccagtgagaacatcttgacatgactccaattccaattctgatgtactggaagaataaaaacacatttatttaaaaaatctaaagcatattaatgatgccatagaaagacatcttgcttaagataaacccattaattttacctttgtaaacatgtttcagcatgactgtgtgattaaggcttcattctgtgcagactacaactgtagtaacggcagcagccaagaaaaaatagcaaaatatttttaaaaacagaagcaaacagcaaggctttcacaatccattgtttaaattcatcttttatatcttgttttattacgtttttctctcttactttatgtgtataatgaaataccattatcactgtcatcatccccagattaaagcttcgagaaagaaagaaagcctatcctagaattgatttttaggccattttacttgagatgatcgacaataagaggattttcatttgctttgtcagtgtaagctggctgctgtgcatctgcagtgaaggcagcacaggtctctgtttgcattctgcggtttgttagcagcaatgacctgtcacagaaaggctctacagcacaatatttacacagatcattagcagagcaggccctgtttgccagatcgctaatcagttttgtgactgccccagtttcatcaagactataaataaaataagccatcggaaaaagctccaaaatgggcattgtcagagctggtgacacttctggcagctctaggcatataaatcctctgataacaatgcagtggtagtgacaaataaaagactgcatttaaactatgagtctgaaaatgagtgtgtgtgttacttcaagaggaccttcttttctttatactctgtcgatttcagcttactctagccctatggtgtaaacaagctagcaatagtcaagtaggatttgcttttttctcctttcactcacgattgaaatttgtttactgcagtttgcgatgtagagtccatgacatgtgaacccatggtgaaaagccacaaaagaaggggaattcgtaagtgagagggcacgctggacttactggcctgtctgacctccgttgaaaatattactcacagaatcagtagcattcaaaatgctgacagaaagattgtaagaggtcagcaaagggtgaacctgtataagagcctagggaccaacctttaagagttatgataaactattagctgtatggtggccacaattgaaatgcaactatttatttatttctcttttttcattttttgatatgtgcccaaatcaatagtgattgctttctcctttgttgtagaaaaaaagtatataaaagactcagaagagtcaagccctgggatgttttaataagaagttgacattgaataaaaacattatttgcaaagagagtttattaaagtctttcagctttgctccctctgtctcctttgtcacttgactcttactgagaaccacaaggccatctagtagagattacatggtaatcattagtagacagatgcaattttgtctgccatgtaatctttactttctgttccaggaaaatatgagtatttttaaagttagtggaaatttacagattttctatatacagggcattggcaggccagagaaacgctaattaattcatgtcataaatgtttattgtgcagctactatgtgtactggatagaaagtagtatctgacagacatgttccttgccctctgaaactcagtttagaaaagagaatacaggttcaaatataatgaacatttgttttattttatattacataatatctttttttgttgttgtttctatcttcattttcaccaggggaagggaatctgtgtctattggaactcttttcctatatttgttttaggattgccatacctctggtttcccaggtatagttcatcaaaactagggacagatctagtctttatgggaactgcaacttataaaatgtggagttcctctttaggaaaaaggatatgcagccctagaaaatgaaaggatccaaatttttgaagaaaatgaacttagtatggtatattcttactttttttctgagtgaaagatatcttatatatcataccaattcccaataagtttcatccttttgtctgcgttattttcagttttcagtaaaataaatgtgtgtataccacaacctctaagtacttcctttagaccttatggtttgaatttggtatgaaagaggaagcttctaaaagtgttttctatgtgcatgatgatttataggcaaatataccggcacatatagttaccttaaaacttagatatttaagtatatgttggatgaatgaaaaaattgaagaacagaaaaatgtaaaaacaaaagaaggtaagtcaaacattttgagagagttcttggatgaaaagtagaaatttaaaatgtaaggttgtaaaaaatagcaatgtccagtaaatgcatgcacataaacatgaaataacttaaatgtcattatgctaattttacttgcataaactttcaggacatgaatacagataaggacataattacagtagttagaatgattaaaaaatagtatgccccatactatgaatttcacacacagtttgattactgggagacatttagagcagcagactaaatgtataggtgctatactgtaaattgtaagttggatgggaggccatcaactttggtattggctatagcacttcaattaaagaaaagtggctgggcctggtggctcatgcgtataatcccagcactttgggaggctgaggctgaaggattgcttgagcccagcaattcaagaccaccttaggcaacaaagtgagaccctgtctaccaaaaattcaaaaaattagccagacatagtggcacgtgtctgtggtcccagctaaatgggaggctgccttgagaggattacttgagaccagaaggtcaaggctgaaattagctgtgatcatgctactgcactatagcctgggtgacagagtgagatcctatcataaataaataaataaataaaataaaaaataaagaaaagtgtcatttacatctttttacgttttttaaaatcctgtttgaggtattttcttatcactatacaaagtcactaaacatatgcattctataatagggtaatcaagtaaaaaaaagagaaatttattttttcataatatttttgttaaaattcattgaaggatatcttacagaaaatgtgacattcttacattctgattatcagggcacaatttgataaaattttatcaagtgaacaataatctggtaatcagaatgcagattaagaaagagaacactaaaacctcataaccctaccttccctgcactatttactctaaactccattccatccattaaagatagtgatgactgaatttttttttttttttttttggctattcttctgactctagtttctgagatttttttttttattatactttaagtgttagggtacatgtgcacaatgtgcaggttagttacatatgtatatatgtaccatgctggtgtgctgcacccattaacttgtcatttagcattaggtatatctcctaatgctatccctcccccctccccccaccccacaacagtccccagagtgtgatgttccccttcctgtgtccatgtgttctcattgttcagttcccacctatgagtgagaatatgcggtgtttggttttttgttcttgcaatagtttactgagaatgatgatttccaatttcatccatgtccctacaaaggacatgaactcatccttttttatggctgcatagtattccatggtgtctatgtgccaaattttcttaatccagtctatcattgttggacatttgggttggttccaagtctttgctattgtgaatagtgctgcaataaacatacatgtgcatgtgtctgtatagcagcatgatttataatcctttgggtatatacccagtaatgggatggctgggtcaagtggtatttctagttctagatccttgaggaatcgccacactgacttccacaatggttgaactagtttacaggtgatgaccgaattttaacatagactcagtttgcctggttggacattaacgtgtgtgtgtgtgtgtaactcttatttttatatactatgtttttttgagatggagttttgctcttgttgcccaagctggagtgcagtggcacaatcttggctcactgcaacctccgccacctgggttcaagcgattctcctgcctcagcttcccgagtagctggaattacaggtgctcaccatcaattcaggctaattttttgtatttttagtagaaacagggtttcaccatgttagccaggctggtctcgaactcctgacctcaggtgatccacctgcctcagcctcccgaagtggtgggattacaggtgtgagtcaccacgcccagccattttgacataattttaaacttagaaagaagttgcaagaatagtagaagaaagtcctatatacccttttatccagatttttttctaaattacatttgaatatattggtagtgtgctctctctctctctctcctttctatactatttgcaaattggagccatcttattattttaatcctaagtactttattgtatatgtcctaaaaaccagaacattctcttaggtaatcacattttattatataattcctacatagtttaaaaaatcaggaaaatttagactatattttagtgttttttaaaaatatatactaagtatgaattatttcttaatgggttaaacatagacttggaactaaaaaactctaactagggccactctttctttatagaagttattgacattttctcaaggagaacagatgaaatcctagggggcatgccttgcaaattcatcatttaatatgagaactgctactggtagagcaacagctatttggccctatatttcagtgaggccctaaatggcaacaattttagaattaatggcaaatgtagtccctgattctttttgtttgtttttgttaatagactcacttcagcgtccatcaaatattccattaaaggtcgtcttcttggtttcttgatgtagttgctgttggtgatatttcttaatatattaagatggaacaacttaccattccattttgagtcatattttaattcattaagctaaaatgtttgagtaaatacagggtttagcatagtattttgcacagaatactttaagaaatacagatgtttaaaaagcaatcttgctcttaaggaccttcaatgctaatagaaagaccactcctataagaagaatatgtgatgtaatcccaagtgcactaaggattttgatgagggaaaaattatttctccttgggtttatcagagaagatcttgaaagagctggcatctgagatgtgctgtgaagttatgtaggtttctacaggtgataatagaaaaagagtgtatcgaaatgggtatgtgtgtgatgccacaaagaaattttagtagaatttaaggtactgaatagtttgatgagaaggtggtttagcatgagcaagaaaaatgaaatattaccggaacaattttgaaaggctgtaaattactggctaaagagttggatatttctcagaaaatgtagggaaccgtgaacattattttttgaacaggtgatgcatttacatgatacagaattggaaaattccacattctatccttttctattgtctgcccagttcttacctcttaacaacagcttcttggtgtcttaagtattttatgtatatataagagataacaaaatacattattgatttcctttatttggacagcataacacgtatccttttggcacattgctttattcgttagcaatttatcttgaaaaactttccacattaatacatatagaaaattttcagtatttttactattgcagaacatcaaagggatgtgtcatcattaagtcgtactatattaaaaactttgttgttttcagaatcttgttcttatatatttttctgcaatgaatatagtcatatatgtcgttttatatgtaagtagttatttaggataatctgcctagagtataattgattggacatgcacacatgcattttttatttgataaatatgtactaatttatactccaatcatgtggatgcatgaatggtagtacctacttctctatatgtttgctgaagtttgtgttattaaatatgctattctaataagtgaaagaatattgatagagttttatttgtagttttattatggttgaacttgaatacacttttgtatacttaaaagtcatttgcatttacttaattttttatttttattttatttatttatttttttgagatggagtctcactctgttgcccaggctggagtgcagtggcacaatcttggctcacttcaagctccaccttctgggttcacgccattctgggctcactgcaagctccacctcccgggttcacgccattctcctgcctcagcctcccgagtagctgggactacaggcacccgccacaaaacccggttaattttttttagtagagacggggtttcaccgctttagccaggatggtctcgatctcctgacctcgtgatcaaaccgcctcagcctcccaaagtgctgggattacaggtgtgagccaccgcgacggcctgcatttactttctatcaattgtttatatacttgcctatatttcttttgagtttgagtcttttgctcataaatttctagaaacacttcatatagtaaagaaattatactatatgaagagtaaatattattctttacttgattacttgtagtttcaatttgtttacaatatttcacttgatcttagccaaaagactgagaagtgaatgtttacaatattttttcatgaagttattgttactgtattcacatatacccattttttaatcttttagcttctagacttttagttataattacttataccttaaccacttaaaggttataaaggaaatgtcctatgtttacttctagagcctttgtggttttattttctacatttaatgctttaatctctttaaaaataatcttacacgcagtaggggcatatgaatctacccatgttatttttccacaaagtggtaactcatatttctttactggtttgagcattaatatacactttttgggatattctattcttttttattcaccaatctagactctattaaaattctcacagtcctgctttaaaaaaaaaaacttattttttcttttatgctgtcctctatcagtcacatttatttacatctttggcccttctggttttaatttgaaaacagcctgtactttctcatccctagtaggcagaaaagaatagctgttcaccatttcaagcctctttgtttgaaaaatgcattcagtgccagtgagatttacatacatttttagtaataaaaaagtaaaagttttttccttaacggcacaaatcaacctgagttactgtaaactactttatgaaatacttttataaagtattagtacttgcttacagcttataccctgcaaataaagcccacctaaacaatgaagagattgtatattatatatttgaagtagataggtagaaaagttttcagctctgcttgatttatggttcagagatctcagcaaggaagcacattctttctgcctctccaccctgcagttcacctattagcttcatcctacttctgcttccccttgtagtatgcaatggctggtaagagcaatgagcagtacaggatttctcattcaaatccagtgaatacaagggaaagagttttccccttttatgaatagaagtctttccttctttatattataatagaaactatttgcactgtctgcttattcccagataacaatttacaaacacaggtactgactgatgtatgtctgattttttgaaacaaccaggagcaatgggaaaataattacccacattgtctaagagtaactgaggcccaactctggaactggggagttctgtttattttattcagatatcccttctatggataaagctgatctttccctaaacacagggacgatttacagatagaatggatatctgaataaaatatggattctgttaaaaaaaagaaagataaggaaaatgtaagagggttaggcagccaactgtgtgcactagaaattgttttcttgagaattccatcaggggcattctctgcattctctactttatatttgtggttaatccactattctgtctctcaaagaatgtatctatgtgtgaactggttttgttactctaatttctgtgtgtccagaatggcagctaattacttggtaactttctctaacctaagattttgaatagctcataagacatatttcttttaattgcggaaatgagaagctaatgacttgattatgatgtaaaagtgagttactgtgttcacccgcattttatgttatagtctatattatgacacatatatcttaagatatatttgctcaatccaaagctatgaataaaacggtaaatacttttactacaggagaaatacttaaagtaatatattttttttggatgaaaagttacttcattagctccaaagtgaattttatatttttagtacacttaaattcaggtttgcatataaattgagtctgtgatatcatctcagaattcactaggagtaagagttcttctttaacacagcctttgtgaagctttgtctcttactcttcctcattacttcccacttgttcttttgaagctgctctattctacagacttttgaggcatttaggggctgaatgattgaatttatttgctctcgtgagataaaattcaagagttttttgtttttttttgtttttggaaaacataaatccttcttcgttgagaaaaaaaggatgggaagcagatctgctatctaggctcttcctttatatagaggacaaggaaataaaagtcatatccctgttgttatgaaataaatcaagttcccctataacctatatgttgagtctctaacccgcaaagtgactgcatttggagatatggcctttaaagaggtaattaaggttaattaaggtcatatgaatgggaccctagtccaataggactggtgtccttttaagaagaggaaaagacaccagtgaagtgcttgcatcaagaaaaggcaatgtgagaacacagtaaggaggcagccatgtgcaagcaaaggagagaggtcgcaggaggaaccaaacctgttgacaccttgatcttagacttctagcctccagaactgtgagaaaataaattcccactcttaagccacctggttgatgatactttgttataatagccctagcagactaatacatttgtaaacatgctaaaagcagactttttgcaaacaagctagttacgttagctagtgggagggtttttatctgcaaggtgtttttagcagcatgtacttggttgtttagcatctcctgtgttaaaaaaaaaaaaaaagcaaccctagaatctatggatatatggggcatcgcttcctggaaaatattatgcatcctttgtgcctatttgattataaaatggaagtgtttattactgatactttttatcttttgtgtaagtaatgtgccagaacttatttatcgtagtaggaagagatccagtgaatactcaacctctcaccttagttctccctgagcctctagacactagacttttatatcctaaaaatgattaaacatttctatttcatatgagtctaatttgacagttgaattatttgtaccatctcaccgatgataaaattagcagttatattgtgtagaatatacagataggtaggttataatttttctatgttaagtttatatagagaagaacaaatgccacttgtaactggtgatgaagcatagaacaatgacttttctacatatctaattcaataaaagagtttacatgtggaaattcaacaaagtaactatactctggcaatgcacatcaacttaactggtgggaatatttcctgaggtggaaatacttcagttttatggtataatctaccaaggatgagtatagtataatccaccaactaagataaattgtctccagttttattaatcaaatgaatattatattggaagtgagcatttaatatttatatagttgtctacttcaagagtttctgattatatacatcagaaaaataaaatttttgataataaaatatattcaaaggatcctcccaaacatcccacagtaacacagcacatgatctaacaaccctaatagtcacaacagtccacataatgtctcattgtatatgcttccggttttaatttgaaaacagcctgtactttctcatccctagtaggcagaaaagaatagctgttcaccatttcaagcctctttatttgtttgaaaaatgcattcagtgccagtgagatttacatacatttttagtaataaaaaagtaaaagttttttccttaacggcacaaatcaacctcagttactgtaaactactttatgaaatacttttataaagtattagtacttgcttttaaaagttatgctgttcaaagagattttgaaaataccttaatgaaacacacaaagtgattacctgtaggttaaaagaaccatcctagatggaagaaacaatgtaatgtatgtatttattgttaaggatttctatcttgcccatatctctatcttaaccaccctagctgtattagtctgttttcacgctgctgataaaaatatacccaagactaggcaatttacaaaagaagaaggtttaatggacttacagttccaggtggctggggatgcctcacaattgtgttggaagtttaaaggcaaatctcacatggcagcaaataagagaagagagcttgttcagggaaagtctcctttataaaaccatcaggtctcatgagacttattcactgtcaccagagcagcatgggaaagacctgcccccatgattcagtacctctcactgggtccctcaaacaacacatggcaattcaagatgagatttgggtggggacacagccaaaccttatcatttcaccctggcccctcccacatcttatgtccacacacttcaaaaccaatcacgccttttaaacagtcctccaaagtgttaactcatttcagcattaactcaaaagttcacagtccaaagttttatcagagacaaggcaagtcccttccacctatgagtcagtaaaataagaagaaaattagttacttcctacatacaatgggggtacgggcattgggtaagtacagctgttgcaaatggaaaaaacaatggctaaaacaaaggccccatgaaattctgaaatccagcagggcagtcaaatattaaaggtccaaaatgatctcttttgaccccatgtctcatatttgggtcacactgatccaagaggaggttcccatggtcttgaacagctctgcacctctgtctttgcaggacacagcctccctcccagccactttcatgggctggcattgagtgtctgcagctttttcaggtgcacagtgcaagctgtcggtacagctaccattctggggtctgaaggatgatggcattcttttcacatctccactaggcagtgccccagtggggactctgtgtgggggtgcccaccccacatttccatttcacaatatcctagcaggggttctccatgagcaccctgcccctgcagcaaacttctgcttgaacatccaggtgcttccatacgttctctgaaatctaggcagaggttgccaaatcaattcgtgacttctgtgtaccctcaggctcaacatgtaaaacctgccaaggcttggggctagcacccttggaagccacggcctgagctgtaccttggccccttttagtcatggctagagcagctgggatgcagggcaccaggtccctagactgcacatagagggaacctgagcctgcctcatgaaaccattttttcctctaaaacctcccagcctgtgaggagaaggactgccacaaaggtctctgacatgccctgtacacattttccccattgtcttggtgactaactttcagctccttgctacttatgcaaatttctgcagccagcttgaatttctcctcagaaaatgggattttcttttctatcacattgtcaggctgcaaattttctagacttttatgatctgttttccttttaaaactgaatgcttttaacaccacacaagtcacatctttttttttttggaagtctcactctgtcacccaggctggagtgcagtggggtatgatctcagctcactgcaacctccccctcctgggttcaagcaattctcctgtctcggcctcccgagtagctgagactacaggcgcacactaccatgtccggctaaaaagtcacctcttgaatgctttgctgcttagacatttcttttgccagataccgtaaatcatctctctcaagttcaaagttccacaaatctctagggcaggggcaaaatgccacaagtctctttgctaaaacataacaagagtcacctttgttccagtttccaacaagttcctcatgtccatctgagaccacctcagactggattgcattgtccatatcactatcagcattttggtcaagccgtagaacaagtctctagggagttccagactttcccacatttttctgttgttttctgagccctccagactgttccaacctctgcctgttatccagttccaaagttgcttccacattttcagttatctttagagcagagtcccaccccactcctggtaccaatttactgtattagtctgtttttatactgctgataaagacatacccaagactgggcaatttacaaaagaaagaggtttaatgatcttacagttccatgtggctggggaggcctcataatcattgcagaaggtgagaggcatgtctcacatggcagcagacaagagaagagagcttgtgcagggaaacttccctttataaaattatcagatcacatgaaatttactatcatgagaacagcatgggaaagacctgctcccatgatttaattacctcccaccaggtccctctgacaacacatgggaattcatggtgagatttgggtggggacacatcactagataacagcaaagctgtacaattcttaaacattgtcatggaaaagtaattccacaactctactttgaactatatgtgatgttgtttacattcatcataccctctttatgctaaactaaaatatttagctgtaatttatgataactatttatagttcctctttctttccctctctgaacttcctgcaataccctgcaaagttggtatattatctacctttttcctttacttttactatttttgtgaacaaaaatgtcagaagatgaagtattttaagtcaatttttttttaaatggtgaaaaattttaaacactgtgaggggccaataaaagagattattttcattgtgagggacattttagcatgagtcaaatcacatgacagtcaattttgttctttgattaatgtacaggtacaatgaatttcagttatgggagaacttctctttctcctttgacttattctctcaatttttgcactctcatttttgtttttttgttgttgttttttttttttttttgtaaagagtttctagtaaggactatgtgttaatcagttttaagaacacagattttatcaaagaaaattatctctgtaaaatatttgcactaatggaaaaatatgtgaaccacccagtcttattttattggaccccaagttagtttgtgtttgtgtgtatgtgtgggtatttatctgatatcaaccattatcttttaacatcagcatgaaacaacatgctggtctgaaacataaaaatatatatcactcttaccaaagccagtctgtattttaattgctttttcctgaaagtggaatcatgtaaaacttaaaaacagattgaaatgaaagggaaaaatttgattctgtaattaacttaccatgtgaccttcaccacactgatggtccttacagatctaaatttctatatctgtaaaataaagaaggttgattttacatgatttcaaaaaatatatcatttttttgacagtcatagaagttttatataattctctattctagtctactgcaaaggaatagcagcaggtgaaaactataatgtttgaccctgaagattattatgtgatatgtgtaagggtcttaatgtgtacaattccatttttaggggctcaagagataaaatttcttttccaaaatggataaatacaaaatcatttttgcaataaaaatgtattgtgagggaatcttttgaatcaatgtgattacttgttgtggaagatacaggccatatggcatagcgtcttgcctcaaggatcttatcacttagtgagtgaaataaaacaattacacagataactgccagtaggcagcactaaatgtcttaagtgatggatagacagagaggtaagaagggtccaatcaaatgctgaaatgttaataaaacccagatcacaggcggtgatgatcaaatgaattgaacaggcttaggagaaatccgtgaaagaaagaaatctgtatccctgggatctttccatttttgagaatatattacatttgaatctcttagggatgtgtgattccccttccctttaaaatagttacagtataatttcattaaaatcttggattttgtcagtcatagcagacaatagcattttatgtcctgtgaagaattgtatgcataattttggaaacaagacaaaggaaagaggctctctaagctgttagaaacaaaggatttttaaaatctttcttctctcatacctccattaaggttgtcttttctcctttaaagctataagaaatattctgaatactaatgtgacagaaccagatgcaatccccaaatatcatatttacttaatataaattcatagtccttacctttaaggagatttgacaattcactttgtcttttagccttggggtagtcaggaaagttaggcacaatgttttaatgctcattccttctcttttgctcttagctatcattaatccctaatgcctggaactgcataaatttcttctacaaaggaagcccacaggtcgtttttatttggagcactttttttaatatgcgccacaatatattccggtatgtattacctcgtctgaatgcaaaactgttttatatgcagatttaaggtagtgagcagtcaagtttaaaaaatggttctggtatcctgtagcttctcaataataatatactcttacattccaacagagaaggatggattatgggtttttcaatttgcatcaggcatattaattgcagagtagggcttccacataaaatatcaatgtactggaacaaactgttaatgtaccagaatatgaacacttacattcatttctggagctttaaaaggaatcatccccctcccccgctttttaatatctatacctctggagatggtacagttttttagtcagttaatgagaactatgtaaccaccatttctccaaaaatccctaattagattaagtgcaatagggctattttagtcatttctgctggggaagaatacaacaagccattagggaaagagaataatttagaaggtttgaaagaaacttattttagagttacttttaagaaacatgacatggaagatcaactttatgtcctagttggaggcagggaggcatactcaacttttatttgcattatattctcaactatgaagagaatacctaaactagtaaaagtttaattgaaagttttataagtaattttcagctgacgtttagcactgtaggtttgattgtagagaactggtactttatttcatgggagtacttgaattatatattctcttgtaagcataaaattgtgaatgtccatattttaaaaaagcattataataataaaaactcttgtgttttaatttgtctaatacatttggtaactaatataaattatagatactctggttagactagaatatagatgaaaatatttttaaatatgttctcttttttctttaatgtgaatatttcttatttttcaaaaaataaagcaaggggaagaaataaagttgagatttaaacacggctacatttttttccctgaggcttgtacttaatatgcaaatgctaagtatttggtaaatattcattaagtaaatatcagacctttcacatttatatttcacttttcatttttgatacatgataaaatttgtgattttattattttctaacaaaaatagaatgggggcccacttttcaaatccattctgcaaaagacaatgtttgagtttttataccacagctgtcctaagtaacgaattatctcaccagagaagagaagaaatgctaaccacataatccaacaggagacttgattcattttgtgtctggaacagtcagtgcaatgttacaaactgaaatgagtttccttttcaatcttcaggtgaaaaaagtagtgagaatgtcccgctttaaaaaaaagaaaatcaatgtgaccttttttttttttttcatcttccttgagaaataatgtgtgtttgtgtgggggtgtgtgttttattttgcagtgttagttttgacctcattatgctcattatgctgttgtaaggctaagtatgtcatgggtcaaaatgaaggcaaaatagacctttctcagcattaaagcacaacctaatttatggtaaaagtaatttccatactgttttaaagaaatagccctggacaacatgaatcttcctttgctgtagcatgctggctgaaaaacgggttagatatgcattccatgaaaagaacagggaaaatcactagaactgtaaactctgcatttgctgggtgctaacattttgagaaatgctgaaagtgtgttattttggttttgtattacatttagtaggtgtattttaaactcaaagaatttgatttccagtaagaagcccaaatcaagtgttgcaattgttttatttaaggtcaattctttcaactaaacaccttttatttccagatgtgttttccctcttgtttgaaatgccacatgacacaaaatgctgcctgttttgtgtgcttttttctactgcatgcatagatagaaaataggttcaagtgtttcatttgaaaatcttttacttaattccaccaattgaaacgatgacatcatgttttcagagtttacctttcttggtaaacatcaccaacaaaaggttaatgtttatgaaggacatcttaaatcttaatttgatgcatacaataatttaaatttttataaacttttactaaattaaataaaagctgctttgaggttgtaagtgataatgctagaggtaatgattaaaggcacctgcccctcctcctgatgcatctaccttctgtatcctctgataaaaatcaaatgaaaattaatctcaggttcaaagtggtgttaactgtattcaggagtcttaggatgtcctttacttcctttgaagcattacctcatgacctaactacaatttcagcatagctgttgatttttgattgtaggttttattttgttttttttatttttacattcttgtggggagggggatttaatctcttaaactttgttggcaaattacattgatgaatgtgttctgacaggaagctttactgaaatgaaaaggagttgtgtgtaagggtgggaataactattctaagagctttttcatggttctcgttgccagggaaaccactgctttgtctgtacatgtttggaatggctgcctcattagaactcaggctcctagacagtcacttgtaatactggtaaagtgaaaggaatgaacctattttagttgattaacttcaaattaataaaaatagcatatttaaaagatagaggtttaaaagctaaacatatagaattatgggggaacaatgaagttaatattgattaggcctattcagccacttgtgtgagtggaagaataattttattttttactttctctttgcctttttacatatttatggggagtaagcaaatggactattatatgttaatgccaccaaataaacttgggatatgatagatcctgattttttcacaaatatacagatttttttcttatgaattcattttttttccttgccatgactggcctgtgtcatggctaaaatattatcaaaacagactggatttactggctctcaggggcacaaaaggtagtgaaaacctagattgcaaatccatctctgggtagtttcatttttcttgaaagaacaaaagaagcagcacactaagaaattatatgaatcaatattaaaaacagaggataatataacagattattgctctaaatttaaattatttttaaaaagacaagaaacgggcatagacagaaacatctcaagttcaaggagctgagactaactctcaatatactactacttcttccttttttttactataagccaaatttcctttggaaatttattgacatttaaaatgtttgtttttaactcatgacaaagagatgaaatctttttataagtttttttcttccaacaacagaagttctttaaatttcttgttctatcattctatctaaatatactcaaagtactataatcttaaatattattatttaatactctttcctaaaggaacaaagaaaaacaaaatccaaagatctttttaaaaagtctatattattcaaataagttcgcttcaaaaaattggcaatactgattttttatttgtagtactattttaggaaaaaatgtcaaaatgatattttggactttgcaagtcctgttttgggtagaaatgtcaaaaacttaattttatgtatgttaaaacttgaaatggccattagacattcaaaagaagatgtttaaaaggaatattttataaatgtaggattcatgggatgtggattttatttgagtgtggaataagagaaaggtgaggataaagtctgggtttaacatgactcccagtcctggatgagcaattgtgtggaaaacagtgccattcattgagatgaaactactaaagcaatggttttcaaccttgcctacacataagcatcacctgcggaactttaaaaaaatacgaattcctgaaatccaacctcagagattcttattcagttgaaatgggtttgggtctacaatagtatttaaaaattgctctcctggtgattctaatatgaaaccacctttgaataccctgatactaaaattcattcttgtgcttcctaactttcagattgcctgaaccttttaggggcacctgaaatatttttaaaatctcaatgtctaggtaccccagatcaattacatcaacatttctgaaagtcagactcagaattttatttttattttatgagacagagtctctttcttcctctgttgcccaggctggagtgctgtggcacaatcttggcccactgcaacctctgcctcctggattcaagtgattctcctgcctcagccttcctagtggctgggattacaggcgtgcaccaccatgccaggcttaattttgtatttttagtagagatggggtttcaccacgctggccaggctggtctcaaactcttgacctcaggtgatcctgtcgtctcggcctcccaaaggtactgctgggattacaggcctgaaccactgcacccagcccagtctcagaattttaaatttcctcaagtgattctcatgagtgtcagggctggggaatcatgatactaaagaaagaatagttcaggtggagaagctgctgtttgacagaaacgtggtatttgaggtggatctggaacaccattctggaaggacttagtaggttcttttttttttttttttttttgagacggagtctcgctctttcgcccaggctggactgcagtggcgctatcttggctcactgcaagctccgcctcccgggttcacgccattctcctgcctcagcctcccaagtagctgggactactggcgcccgctaccacgcccggctaattttttttttttttttttttttgtatttttagtagagacggggtttcaccgtgttagccaggatggtcttgacctcctgacctcgtgatccacccgcctcagcctcccaaagtgctgggattacaggcgtgagccaccgcgcccagccattagtaggttcttaaatgtgaatctgatgttatacagcaaaagtctgtacgggctacagaaacataatgtgtaataatggaaccctgcaagaggagggagtcatgagggtgcttacaaagaaggacgaaaaaggagcaaagagcagaaggttgggaaacagtggcctttgagaggaaggaaggataaaaagaaccagaactgaaaactgagaaaaatatagaaatggatttggaaagaatgatgtcatagaaagcaaggcttttaaagaaaagttgagactcagtatgaaaaaataatacaaaaactaaaaataattaactggacttggaaatcaagggagatattagtgcccttcaaaagaactgttttaggggagaagtagaagtagaaagtatttggagtacatgagagaggaatgagaaaccattgtctgagttagtagaacagtggtttcaaaatacggctgcgtataagaatcacatgggaagggccaggcacggtggctcacgcctgtaatcccagcaatttgggaggccgaggcgggcggatcaagaggtcaggagattgcgaccgtcctggctaacacggtgaaacccgtctctactaaaaaatacaaaaaattagccgggcatagtggcgggcgcctgtagtcccacctactcagaaggctgaggcaggagaacggcgtgaacccgggaggtggagcttgcagtgagccgagatcgcgccactgcactccagcctgggcgacagagcgagactccgtctcaaaaaaaaaaaaaaaaaaaaaaagaatcccatcccatgggaagtttaaaaacaaacaaacaaaaaacaaaagagaaaaccacaacaacaacaaaattatgcctgtcactgtaccctagaccaacggaatcagaatttcttgaggagggaaaaggacatcagtgtggctcaaaacctccccaaggtgactctaatgtgaagccagatttgaaaaacatttcatagaatattcttttcagaaacttgactgaaaatgaaaggcgaggatttagggtagtttctactcggaggtggaaattgtgagagaaaaataagagacttgactgtaagaactatgacagagccaccgtgtctgaacattagttgaaaatacttgagatcagaattcaggttatggtagaaatgaaagtatagaaatcaaagtcactggtggaaaaatcccctctaaaaagggaatggtgaaaagctcatcctgtgggcctatagaaaaagatgtgaaaatgagtaaaattctaattcggctgcttttctttttatttgttatataaagagatacagacaggacattgaaggaatcttactaataaccacaatttcccatatgattatattcaccctttgcatttgtagcggtggaaatatgagggacttgaggtgctttgtatccatttggaataacttatgtgggaaatggaaaaggtgactgataaagatcatgtttaactagttcatatagaccagatgaggtttagagtgtcataatctacacaaatacgtggtttcctctaatgtcattctgatatcaagatacagaaagagaaaaaaaattggtacagtgatccagtacttgtgatcatcatggaaggtagaacataaatgaagagatttaaacactaagaatgtgggcatgaaatttctgttttaaatggtccatcatttgtttagatgaaagaaaaactatggggggtgcttataaactgagataaaaagggaagaatctgaatctttcaattgtacaaaaaacagatagatacagaagtacaatcttcttttagtatttgtgaagtattggtttcaagacccctcagatatcgaaatctgcagatgctctagtccctgattaaaaatggtatagtatttacataaaactcacacacatccttctatataatttaaataaactctagattacttatcatgcctaatacaatgtaaatgctctgtaaatagttgttatgctgtatttttgtattatttttattgttgtattgctatttttattgttttttctcaaatattttcaatctgtgtccctttgagtccatggatatagaatccacagataggaaagacccagtgtagcaaagaggtgagcaggtaaaataataaattaattttactaacagtcttttagatattgaagctctaaatttgaaatagtttgggataaagaatactccaagaatgtctaggaacaccataatccaagataatcattctaggatgtaaagtatgagagaaaattaatacatttaaaccgaagaatttagaatttatattactgtacacttataaacctagatactattcatgataaaagcataattcactgtgaaaagaaatagtaaatgatcaatgagtggggcagtgggggaaggagagagagaggagataggaggcaggggaatgtgaataatctgggttcttgatgtttcagcttctgatagcaccacagcttcctgcaatggattatatactgcccctagaaagatcaaaaatcactgggagaagccatctttggttagatctatctttttaagtttagaaatatccataaaatactgtttttctcatggaataacagtaactcaaagcaactctgaatttctaattcaaaactactctaggtttccagcaataagaaaaggtgtttttttgtttttttccccgtcccacgtatgtatgagtttcactgctgggagattacagggcttgattaagtaggagattttgataatatatcttaaggtattagagtgatatgaatttcactagaaatattgatagttttgttttattttattttattttttgagaatgagtctctgtctgttacccaggctggagtgcaatggtgcagtctcggctcactgcaacctctgcctcctgggttcaagcaattctcctgcctcagcctcccgagtagctgggactacaggtgcacaccaccatgtctgccttatttttgtatttttactagagacggggtttcaccatgttagctaggctggtctcgaactcctaacctcaggtaatccacctgcctcggcttcccaaagtgttgggattacaggtgtgaggcacaatgcccgaacgatagttttataaaacctggatttaaggcagaatttagaaacagaaactctaataggaaaacctttttctatattattattattatttttaatgtaaaagtaaactttagtgtcgaaaatgcaaacttggggagggcagaaagatcacacataaggctgccacctcacacctggagggttgcatcgtggttgggcagaggcactcctcacttcccaggggctgcgtatgaatcacaatgtaggggataaagcggttagataaaaatcttgaaagtaaaagtggataagagaaaaatgcaaaggagtttagagtgatgtgtgaaagaattcaataatagattatcttttacaaacaagaatgaagataaaaatatggtttcaaaataccataaacaacgtacggatttgtgtaacaggttattgtatatgatagttgaaagaaaataatgatttgagatgggaggaaatcatttttattaagacataataactttgaatttaatggctgaacatttatgtggcttttaaagagtcagtgcatttccaaagtggtactgcaatatatggaaaatgccagtactggagatgttgcatgccatccatgcagaagtggacattcaaatcttaagaatggatgagatctctcaaaaggcaattataaatgatgacagtaagagaactgaagaacgttgaaccatggtattaagggcacatgtagcatggcgtgacgagagaacatagtcttagaaatcagactgaattgtgtttgtattgtggcttcaggatttactatcttatcttgggctttcctattaaatggacaatttcattgtattcttattataaattagaaataataactttctaacaggattgtggaagtgtgtgtgtgtgtttatgtgtacacacagagagaatataaataattattaaataaacatttctattttatggtagatcgtaaatagaaactaagtcaaaagttaagtcaaagtagtcaagaagattataaggtataaggaaaattcagtattttagaaaccgagagagggttttaatgacaatggttggtcagcagtttcaaaaaccattaagaaaaattgctcctagaagataagagaatgagtctatcccttacaataagcctaggatcacatttcttaacttattcctctcaaaattgaaacataaagtacttctatgcatattgtcttatttgccttatgtaaaagaaaaaaggaagcaaatggtttccaaatgtttaaaaacatatattgtctctctccccattcttccctctcccctctctcatctctcttttctccccttttcctctcctcccactgtatttctccacattttctagacctatcagttttacaatagagaagttgcatttgaagatgtattagaatcttcccaaatgggattggtcgtgagaaaaactaatatatgggatccctaatgctgaaccaattaaatttgtggttttggcatagcaagatttattgactgatcaatgccatgtgtatggtggatatgcttgccttgtctcacagaaaggcaaacaagcagcccattatattaaagcatgtggattacgttttagtccctatggaaaaataatataacttccttattcttactccaatctttaaggatctcaagagaaaaataattgcataattcatcgtcttttgtgatttgagacatacatgatcatgttattggcagaaaatgaattggttttatacattttattgataagtgttcccaaacgtttgtaattagttggccatattcttgtttctctatcttcagaagaactggttattatgattactttttatgaaggtggtaattacaaaatagaattgagctgaatgaaattaaagagaaactgaaaaaagaaattccctgccaggaaataatttcatttgaacgagtacaaatttctttgcaattcttacttagctgaagtgtatttctagttgtgtttccagatttatatcattatgaaaatagccacttcctaggttctcatttttcatatacaaacaatgttcactagcagtaaatttcttccctggattcaatttctgaatattcacaaggtgaaaattgtgttcacctcttttcagatggagattctctgaactgtaattgggtgactatttcatagatgaaatctcagcacgtatcactttaaaatgatatagtgtaaaagggcccaaattgtgtgtgtacacctggatgtgtgtgtgtcagcatgacgtggaaactatgtggatagataaatatctaaaataataggtatgtagatagcatgatgttccaataattaccaataagatcatgtcttcagtggagagtaatacataccaaatttttaaatctttaatttttttcatatctgattatttctactatgatctcttttttatcagaggagttactaaaactacgagtagataagaatacatttgaatttttatgtgtatgataactttaaaattttgcctactttatagatttctcagttggacttacattaaatctctatttttgtttttaacttggaataaattctctaagacactaattactaaattgtcagtatttataatgtaaacattttaaatcccctaaatgtctactacagaaagaataaatggtgatgtgtctgtgttatggaataccctgaaaaccatggaaaataataataaagctctacgtacattgacatggaaggaataaattaataaattgtttcactgaatgaaaatcatccaagttgtgtaaataaaaatatgtacctgtagggctgcaacattatgcaactcaagcaagtatataattcagcagtgctattaggtatgcattatagatatttctgcatacaaatatacagtgaagagaaataattcatattttaaaaatgtatatatgtttatacatatgtagaaaaagttatgaaagtaaatactgcaaattactaacagtggaaactcttttaacaggtaggtgtgaggttaattttgctttttattttgtgttacacactttcgtattgactgaattttaaaattagatttgcattacctttttttcctaaaaatataactataattgaaaacctagtttctgaattgtacattctgtttaactcatgttctttctctttaatcatcagtttcttcactgacatcacaaaaatactaggaattttccaattgaaacaaaaaacctaaaaatcaggaaaataaagaagtattttagaaccaaaccttctcttagtgtcatcactctttattccaggcctcgaaatgaaatggcacagactgtttttgtctcctctcccgaagatgcttggtttattcagtaatcacctcccaactttgcaatggcccagaaagatagcctttactttgcataccttctaaaatactagcctgattcaagtatttatcattcttgaattatagctagtaacttcttcactggtttccttgcctgtaatttcttacctttgcagtcatccccagatattgccatagggctatcttcctaatgcagagatcaaatcatgttgttatacttaaaatatttttggctctatcatccacagagtaagtttcagatttccagacatagcatcatgacctttcatgtcctattgccagattgctcttttagcatcacttcaaacttcactgtttttttttaatatatatataacttttaagttaagggataaaggtgcagatttgttacataggtacacttgtgtcatggggatgtgttgtacagattatttcatcacccaggtgttaagcctaatactcattaattatttttcctgatcctctccctcctcccaacttctgcactccagaaggccccggtttgtgtgttgttcccatctacatgtccatgtgttcttatcaatacctcccacttaatagtgagaactccaagtgtccataaatataatataccattttatgcctttaagtcttgttgtttacatctcttattcttctagtctttcaaggcccaccacaaatatcatgcttatatctgacaatggaaagaaatattcctgctctcctagggcactttgctttacctatattacaaatcttatttcatttatacttactttagttagctttcatttgtttcactcagcacaaaataatgtagtcttgaaatcaggacccactttcgattgatctctgacctagagtccttatctgaattcaatatatttgtttgccttgcttttaaccaaatatatttggaatccgtttatccatacacttatgaggaaacagtattgaaaaggttgctatccattaatatggctgtggaaaaaaaatgtcaccttagttctattttaagataggaaaaagtcttatctatttttagtagatttgataatactcgtatgagtttaaatcttactgatgctgtacagttgtgctatccaatatggtagccaatagacgcatgaggttatttacatttgtatttaaattaatcaaaataaaataaaagttccataaatataccattgtatgcctttaattcttgttccaaggtttcagtatattatagaaatttttattgtcacagaattttccatttaaaacctctgctctaaagtttaaactcaaaatataaattactcctgtgctaacttggtaaaatcctgatacagaaatggcacagtttacagtagattttttgcattgttttgatctaagttgaatatagtcaccaggcaattgttacagggagtcatcatttcttttttttctttttttttgagacggggtctcgttctgttgccaggctgcagtgccgtggcgatcttgactcactgcaacctccgacactcccagattcaagcgattctcctgcctcagcctccggagtagctgggattacaggcacctgccaccacgcctggctaattttttttgtatttttagtagagacagggtttcaccatgttggccaggatggtctcgatctcctgacctcctgatccgcccgcctcagcctcccgaactgctggtattacaggcgtgagccaccacgcccagcctcatcatttctttaacactttaaaacttattctaatgaactcagttgattgcatatacccctttacccatccaggtcatatgaatcactgtagtagaatcagctactctgggggaaaagaggagaagaggttgtgcatgtttgtggagtatgtattattaaacaaaagtcccagttccctgtggtagcagatctgaccattctgaccatcctgtggctcaattttaggaaataatgtctaagaaggaatcaagaatgaatggatgtactgcactcaaaatataaatttgttctcatcactagtgtggatgtgttccatccttactcagtaattgtatacagtgtcatgccttcaaaccttacataatcgtctgtacttcattcattctcatccttcaaggttcaccttaaacttttttttttcctaggttttctccacactagctaggaagtttgcatgtacagaacgtaatgaaaaaatgaaatttctctatgcaggaattcgacattgtgtgttgaatcctgtgataacagcatttcctatgcagactcaatatatatttgatcatctaacatgaaaattgaaactggcatctgtttgtaaaccaccactttgctggctcaattttagacctgcaaaggaatttgctgcccttttgttaactagataagctatatatttcactttgaaaagacatgtccctgcaactttgatggtgagatactgcctcataacattcatttttctctattaaggtattatagttttgatttaataattttcagcaaagattcatttaacactagagtgaatgaaaatctaaaagaggatcaaatggttattagtggaaacagaataacatttaccagttgaccttctgtaatggagagactcctcagtgggaagaaatctttcatgttgaaactttcctgatagagaactctttgcatatataatcaataaggtatgggcatagcttcatctttggtatgaataacaaaaaagttgtcatagaaagctgtagaattaaaatttatttttcagaaggagtattgtttgcttctttcaaaagtggaggtaaaaatgatacaggggaaggtaccctcaaataaattagtataaccaagtaatagtttttcagaaatagattagaaaatattcatcccccaaaattaatgtttgctagttacatttatcaatttcctttctacaatgctaattttaacatcacaatgctttcattagtgcattatataaaatatcaggtatatgtagattggtgttgttgaaataaggttttgttgtttaaaaataagatatccattcaatatacatgtattaacactaaccacagcaaaaaatcaaaaagaaaaattaagagcacttttttcgctactccccttgaacacacttatctcttatgccttaaattagattgtatataacaattctaatatattggtatctatataattatataacttaattttaatcagggaagcaaatgaatattcctcatcattttaaacctttttattgttataccatttcctttttccctgtttttatgcttttgcatgtttaacataatatgaaacctcaaaagatatctctgggcaacttctgaagattgctatgttagcattgctaaacaaatgtattcaaatgcattttcatgactgaatattatgcaagttcagtgttaaccttttccttgcttctttgaaaattgttttaggatgtttctgaaaataacatcatccagattaaaatgatgaaaataccccaaaacatataaggctcataaagagtgtgggatataagcgtgccagctaatctagttctcattctcataaagggcaatagtggcacttaagagccagtatacctattccttttcattgtaataaaaccattcctgaaagtgactttgtccagagcaaatgactctaacatgttgtacttcagaggtagattgtcataactcactaaagaaagtgaccattgtatatcttaatacaaaaattacctgtttattcaagtattttttttttcaagctgaagatattttctcctgccctcccaaaacttagcacaacgcttcagtagaaaggggtataatctaactgctgtcatggccaacaaatggaaaggaatgcagaagaaataaagaagtatgtgttttttctgttctaatagagaaacaagttaaatacattaaatcataaaaacaaaaacaaaaaacaccctgacaatataaaacactgatgaaaagtctactggttaaaagtgaaaattttgaaagcagtagttgtatataatcagtggatatgccttgcttcttttcaaacaagtggtttttaaaggtgtgttgcattatgctcaaatgatatgtatttatttcataaattatataagtcttcttaagctgaatcactcaaatacaaaaacttgggctttattttaatgtttttgtaaaatggttttttcacatggattgcaaatatcatataaaccgatgtttaacatgaatatattaaagatttctttggattataattatatgaaagagttatacatttgtattctcaagacctttgttatacattgtataatgacactttctaccaaatatgaatgagaaatagtaaataactattaaggcaaaagaccagaagaggaaaactatgaggaaagacgatataaatattcctagtttttaaattaatttttaattgtgttctttctgatgacttaaaacaatgaggatctgcacacctgtagtctgaattcagtgttatcctcttttgttaaattgaaaaggaggcaaggatagaaaaatcattcactggctagagaatgcttctggtcaggtcatggattcatgctgttttcagtatataatttcattgtcaattgaaacaaagtgctaattgagcacaatattgatgggtggttcagaggtgagactagtattgtcctctaaaagggattaataataaccactcctgttgcagcttccaccaacatgtctaggagaggcatgcaggcaattatctgttcctcaaagacatttctcctggtgcataaattatcggaggcctagactagtggccctatagacccaaccaatagctcttactgtctcaaagtggtttatatcatgaatggcctttgttctgatttggtcaaaatcttcatatattttgaaactgttataatttaaagacttcacaaagggacacaatactagtctctcattacattcagttctgtaaaggcatctactgtgttactgctggataataataaccttcaaatgattctataattttaatatgttcatcatcacagatttcaaactttggtttaggtttgccttctgaagcagtactgaatacattgtttccattttgacaagtcaaacaacctttcagatatttggggaaaactaagttctgtggttgattgataactataattttggtaccccatattcttcttcattttgcattgtcttttaacgtttcctttgagaccttatcccaatgccgggtgcttcagaggaagttttctcaacctcaccactattgatatttcagaccagataattcttggtcattgggacgtgtcctgtgtattacagactgcttatgaacattcttgggagtgtttgtggtggtatgaaaatgttgagaaaactatacttcccaatttcctgagcagttgggagaagctacttgatgcaactctggcaaatgagaagcaaacaagatactagccgatgcctctgagaaagctctttaaaggatataatcacttcttgtttgttctttctcactgaatcttattccgtaaatgcattgtcaagtgatgtgacaacagtgttatgcttcaagcctaagcaagactctaagaatactggagtgagaggattccaccagtcttggtccttgaatctttctttgctcattttggcactcagtccccagatatcttgttgggggaagaatagtggcaggaactaacttttttaatctactagttttattttgtcttctataaagaaattaaaatctacataatctctaactaatagtaatagctttgctttaggaaaaaaacaagtgtccatattataaatatctcaagcttcttcttatgttcaagctgctttcaaatgtattttttttcagtcattcctatttatcatttctcaactacaatgggcaaggtaccctactaagctccagagataaagataaaagaaacaatattattatttcctcagaaagtctctgaggatagtgaagacaaaattaatggaactgctagtgttttgtgataattgtgtgtaaactatcaggagaataggagaatattagacaagataggaaatgaatctcaataaaaaagaaaatacaataaaatgtcactgttaaatcatttaaaacatatgataaaggcaggaggagctattgctgacaaattcctaattttatatctgttacctcagcatcatatatgaagacataaaacaaaacctgagttttaaatttccaaaactatctgttgcctatccacatgatttttcttttactgtgtcacagactagtatattttcaagtgcctagctaggctcaattttatttttgtttcagttttatagtatttaataacatcttttctccccaaagacctttgcttagaaaccaagagatacacaatgaggagcaagtgttgtgctaagtacccctctgtggcacgacctgtgggcatgcacctgccttcctcccagtgtgctgattgcattcctctcactcccgttgtcagatttgcttcctgagctctagactttgtcattagttatgactcatcaattgtggcataatcatatcaattccagcccagtgtcttctgtcctcatttaaatacaaatttttcttctattaccaagctatcaaatatgtttcattcactgagtctttgtaataaaaggtgaaacagcacagtctgcactcaacagccagattttttttaaaaggttgtaacattcgaatgatttgcaggcatttttctaacacattctttatttttgaaaacctaacatctatgacaccacatatgtatatctgctgattgtagttagcagtctcattcaacacttattaaaaaacatgaaattgtcaatcctatcaagttgttttttggttgtttgaaacagctctcagccatcttggaactgacccagagtgtaaaggtcttgaggattctcttcatcagtattacctgaatacaagccttctgaaaggaaaaagaaactctagcttttcaaaccagaaagtctagtaaaattcaatattgtaaattgaatttctttatttttaacaaaatataataaatggtagacaaatccattcttacagttctatttacaatcctctttcagttttatctacgtaagcaccaccatgtaggtttattatattttctgttcacattttttttcctacattttattagttgcatttccccctacatttttattttagtgctgaccttcaatttctcaggggtcagttccttgtacataaataatacttccatgtttcatgaggtcagttaccgctcaaatcggcacaaatggcagaaaataaaaacaacagaatccaaaacttctccctgagattttatcacatgttataattttagaattcccactttggtagcttttactttattgacagattgaagtttaactgtagccaattttaaaagacagaagtacgactgagttatcatatagttcagtgacaaatcatattaacattatattttgatatatctcaatacaaatacagataattctctgatatcttagacccatctcagatacttttgtttctacattaaaaatagaaataattcaggaaaataaaattggtgaaaattacaaagcaaatatccaattttttcgaaagaacaaacttgtctctaattgtcattcaatgcaatttcatttttgtcttctgtagttctttaaatatgtattcaggaaaagtttccagatctgtaaaaaaatctagcagctttcatgacttcttttggttattggtatttaacagatagttatattatgttgtaaaccacaattttatttcagaaattataatatgaatttctatattttaattaaaatataattcagatatgttttctcccctacctctttcatctgtaggctgtgggaaggggtcattcttggtttcttttccttttcagcagttttcaccttacttaccccctctcctattggataactgcttctactgaccactctaggactgaagtctggaaataggagtggtaatgaagagagaaatttctttcttaactgatagtaagtgatcatttaatctacaactgtcaattcccatgaaacttttcactttctagaataagcttgtccaacccacagcccaaaggccacacacagtccaggacagctttgaatgaggcccaatagaaattggtaaacttttaaaaacattatgggattttttttggtgatttttttttctttagcttgtcagctatcgttagtgttagtgcattttatatgtggcccaagacaattcgtcttcttgcagtgtggcccagagaagctaaacgattgaacacccctgttctagaagttcattccatgcaatggaatcccacccaagtgttcttaaagcacacttggcttcaagccatctgccatctttcattgctcatgtggatcatttccgatctgggttaaaaggtaatgcattcgtgggccctgaaatccagaaagtgaaaccccaggtcagctacttaatttgcaggatcccttttacaaacaaaagaaaatataatagaattttttttcctatggtttctttcttgacctgtcatgatgttttttctttgctcttaatttcactctgccttggaaacagggatgctcacagagcgctcaaaattactcaggatatgaccctgagtctccttgtatttggcctcagacccctgctgggtaagaggtggtgtagtggtctctaggtatcagtgggggagcaagatggcaaaaggtgagatcacatgtgagctgaggccccatgctcctggctcatgctccattgtcccatcagagttcacttacaaaacacaaattcaaagataaaattattaaggatttcaagacagtaacagtaaagttttgaaggatccactgaatgtgggttcttatacaactacagtggtcacaaacccatgaaattgacaatctaaatgtattagcagctgttctttaatttaccagcaaaacagcttatcagcctttgtcttttactctaattctggaaaataattaattaaacatcagactcctgtgccactcctaaattttggagatattcatcgagctttataaatactctcccctcacctgagtggagaaacattgctaccctcccatccaatgtggctattctagaacacctttcccaactaaacttttcatgagaaagaaaattcttattttcctcaattctggtaattatttgtggtgttttgcattgtgtcatcttgagtaggcaaaaaagtacattttttttcaagatgtccttctctgtattatccaaaagaggaacttgtacgtaactaggaaaaaggaagtaaggtggtggcccttattctctgaaggtcatcataatcaaatgcagtatcggatcaatgcagaggttccagccggcttgcaacctgtcctaaatctgctctattccacgttcaacacctttgcctactgttgcctctgtccatcaacagcagcccaagactcaccaaaagattcttagatgtgaatcaacagaggttgtagctacacaaaatcacagcctctcaaagggcatcccaggagcaacccttacataaagagatatgtttggtatttcatattgacttgttagtgagaggtcctctgattcttgaacttccctttcagaccttgagtttcccagctacttgtacagctctacatatctaattcctttaataagtcctttatcccataaaacacattactaactttgctcccctgtctgactcctgtctgatatatcattttgtacttgtattttgagttaagcaagttcttaccaagtaattttaaaatctacatcttgtaattctattgatttatttcctatggtcttagtcaaatttttgattttataatctaactttactggcactaattctttatgctgtggtcattgtatcggagacaaaatcaaagtgtcatacatcaaaaaagcaatgtggaaaggagtaaagaagtccctggaaatactaggtgctcatattgtaaaaatttaccttgggcagttatccctaggctttctacaaaaaacaggttgacattagatctagcagtttaatctgtattgtcttttatttgtcacaaatgtgtgtcatgcctataattcccagaaattacactgcttcagcctcactgatagtaaacctgtgtgctcatagctcttatgatatatatctaattagtgcctgcagggaaaatacccctaaacgttctgtcctatgttctgataacggattctttcactgttacttccatgaaagacgttttcttctcttacaataagaagaccaggatattctgcctcactatcagtttgtgtagaggttgatctgttctccattttagaaaatcagcagttggaccaatattgcttctgaaactgtgatatatgcactttgcattttataattttattcattctgagaacatcagacataaagattttgcttcatcatatattccctgactttctcctcatttttttttattccttccttcagcttgactcaggctatgcacactctgggctttgaagatatggcctagctttggtctctggggactggttgtgctgtgccaaacatttcttgtgccatggtccctctttccagaataacttgtttttacttttattattggaagtgattgtgcagaatcgatataatttcctgattaaatgtttggtaagatttagcagtgaacttatctagccctggtgctttctatttagcagggtattaattattaattcagtttctttaatagataaaggcctgttcagattatctatttctcctcatgtgagttttggttgattgtgtccttcaaggaattggtacatttcaccctcgtcattaaatttttgtgcataaagttgttcataatattcctttactatcctttaatgtacatgggatcactaatgatgtcctctctttcatttctggtattaataatttatgtcatctctatttgttttagttaatcttgatagaagtttatcaatattattgatgttttcaaataactagcttttttctttcatcagtttttttctatttattttttggttttaattttattgatttctaattcaacacaattttgaaaatgcataaaggaaagcacagtattataaaaggtaccaattctgttgaaacatacttaaatattttttaaataatttttaaaattatactaaaaggttttttctaatgcattaataagacaacatgtatgaactataagcaataaattttatttgttaaaggcagattagtgttaaggtattctctttaatttgaagaaattattaaaccatgaggtaaaatttgataaatcctcatatatatcatgttagatatctaaatgatttatttttgttgtttctttataatttatttttattgcttgtctgtttaccaatgttaaatatattgatttgtaaggatttactcttccaagtgtaactaaggttttcataattcacaccagatgaaggcaggtgtctctcaagaaaacttcaaattttacaagattatttggtgaaactccaactagagtaatttttttctgctaagatttaaaatggaaattcttaatattttgcagcttggaagagtaatttctaaaaactcagtgtgattttcagcttctgattaggatgtagaaaggtgaaaagaatgatgctcccacccttaaggtgagaaatatttgaattatctacaaagtcataagttgttttcagcccatcagagatgaagttgcatggcaaccaagtaaactggttccagagagggacaagccctcaaggatggaaaggacacaaaatgagtttcatctttgaccaatcaaaaaatgaagaggaagtcaccatataatcatataagaaatcagctaaactttaataaattcttaaaggctaaatgtgggtaaattgtaagtttagaatagcaggaggcctcaggcacaagaaatggtcatttcttaaactcttttacacggaactttgtctgttgaagggaaagactgggaactgggcagaagatgagagagaccctgctgcatagtgcaggcttcgggtaataatcagttgctgctgggggactggcaaaaagccttgcccactaccccagaacattctttcttaggaagcaaagctttaagccactatagaagagacagcacaactgtcatttccactaatcacaggcaaagatgcactgaggcttgggaacaagtggaagaatgcatcctatatctttggaagagtgctaggaaacagttgtggctaagattctataccaataacaagaagaagcctttaactactatagagtggtaaatatttccacccaaaaccaaccacagatccaagacagagtttcattgtcatagatgagttggacacaatgcaagaacactaagaatgccccattttgagaaaaaaaaaaattcagcttaattcaatgacagtagtctaaaaccaacataacaaaaagacaaaaaggaatgaaaacttggacttttttcacacaggacatacctaagattgaatgaggctgagacagggcaacataaaacaccccactttttacccctatgccaagcctgataccaaataataagcatcagctgtctacgtattgagtaagggaaagaggaaagacagagaacacctcggcggtgcaggaaggtaaggatgctgaaagctgagaggggaacagaggtactaaacaaaatcctccagcaccccaggacccaccttaaacccagccaacatcagccattcctataggaatttgaagcctgtgtggactgaaggtaatgataatcacgataaaatctatatctagctcaaacccctgactaaaacagtttgctgtctcatacaaattgtcggacaaaatgatgtgctcttttgctggcataaatattattttaagagtaattactgctacctacttgattttggaataaaacatatgctagccttagctaggcaatttgtttttctatattcagaagtagcataataaataacagattcttaaaattctgatagaatttacttatctgaggatttgaaggaatgatctttaatagactaagaaataaatattgaaatgattgttagatacttcctgtaaaatcctatattctttatctttagttcctattattaatacatcttagttgttacagtccttacatctttccatctctagcattcacatttattacaatgaagctattttaatacttaaaattttttaattgtgcatattacacagtctctcttattgtcttggttaaccttccacaggtttctgtatcctaaatgttttctcaaaaactaacttttggttagaataacattctttgttgttgctttaaagatttttgttcattaactatttctattgggtttcctccactgctctttctccaatttttaattgaaaaatagagctcgtataattttaatctttaataataaatgtatttcaatgtacatatttttaccttaaattatattatgtcatgttgtcatgtaaatattgcccctctagctttttagtatttaagcctggtgtgttataaaataattttaatgttagtagttatatacatatatattttcttttaaattttaacttatgtcaacaacatgttttggctcttattaaaaaatttataaaagtcaggatcctttaattactgcttttaacttatttgcatttattgtcattattgttacatttaacttagttcggccaatttacatcatattatacatttactcacatttttagtttgtttcctttccccatttcttctattgtttgtctatagaacagctcactatattagtttaacaagtatttaaatttatctctgtggtaattatcttaacattttaaataagaaaataaatattactttcttaaactattgatatctgtatattgtatctaaagatacatttgctttgtcatagtcatgtgtttcttagatttcaatttcatctttctcattatatagataatttctataatttcaattctgaattgcttttgttttaaaatttgcattctatttttttccttgtttttctcttttctctaaactataaactgactctctactcaactctcttcttatgaaaattgtataaaatatgcatggaggtatcaaaaatattccaaggcattaaagattacagggctaaaataccgaagaaaacagcacttcagagaattgagaacaatatggactatcccttgacccatgaaagattttctcacatgtatgtggctattgatagaccaaaaacctaagcagaaatattcatagtcttatagttttaagagaataaaatatatggctcaagacttatcaatgagaaaggccgatttatacaccccaggcttcatttgacacttcaaaggtttaggaatattaatggaaataaatagattataattcacaataattgcagtttggtctcaaaccagcttaatcactgattatatgaatatgatctgtaacacaccttagataaccctccaaaaaacagagttagagttaaccagaattaactattggctgcaatttcattagaatattagaaatattaagggcaaaagccacatttaaataggtaaacttaacatttttcaaaaatgttggaagccaggcatggtggctcatgcctgtaatcccagcactttgggaggctgaggtgggcagatcgcctgaggtcaggagttccagaccagcctgacaaacatggtgaaaccccgtctctactaaaatacaaaaatcagctgagcgtagtggtgggcacctgtaatctcagctacttgggggttgaggtgggagaattgcttgaacccaggaggcagaggttgcagtgagccgagatcgtgccactgcactccagcctgggcaacaagagtgagactctctcaaaaataaataaataaataaaaaataaaaaaaagatggaaaaactgtaagtcacagtctcaggaagtgccagagtgaagcatgataaatatggagacaactacatagctcatattagagaattaacgacaaagagactatctcaaaaatagttctaggaaaaagcatattaccttcaaaaagtggcaatatgacttagggatgacttctcaaatggaagccaactggtaactagaattttattcctaataaaatattatggaatatgagaaaaaaataaattcatgttcaggaaaacaaaaaataagggaactatctatatcatttatacattacaccaaatgaaataataatgtctttcaagcagaagaaaaattattttacatgtaaatgtagaaatttagaaatgaaatcaagaaaagaaaggacaaaacatctggataaatctaaataaatagtgactatataaataaaatccatcatataaaatttaaaataaatatcaacaaaactacctaacaaaatatcaaaagtattataagatcttcatagtctaagaaaagtaatgaaaattttactttatactcagacactaataagtcaaggaatcatgaaataatatctagggcaaaatcaaaagatacttaaacttataggagattataagggcatattggagaaaaaaatgcttaattgagaaaaaaggcaagaaagagcaagtcgaaaatacaacagatggaaaaatagcaaagtggtagaccacaatcaaaatatcttgagttaaatataaatgattttcatacttcggctaataaaaatatctaaaatgaattttaaaagtaattgaatgtgttttattaaaaataagaactgaggaagtctgaaaaaaaaaatgtaaaaatggtctgttaggctgacataaccaaaagaaagctgagatagatgtactaacatcagatgaaataaatttagtggcaagaagcagtactaagacaaaagaatacctttcaaaatgataaaatgagcagtataccatgatgtgacaatttaaaatttgtattaatgtaataatgggagaaatataatgcatccatatcatactggggacttttgcccacttttcttacacggttggaagaagtagaaaaaaatgtaattaagaataataaagaattagatatctctattagcaaatttgatctaattgatatatatagcataatattaaactcgataaacttaaaattgaatatgtaatgtgaatgcacatttaatatttattcaaatgctctatattgtgtcatagatcaagccgtgacaaattttcataattgaaaatagaaataatacattttctgacatcagttaaactgttagaaatcatttacaaaaggacaacttaatccacaaatattttaaaatcaagcaacatattcctaaataattcacaagtcacaaaattagtctcaatggaaattagaaaatattttaagaaaatgagaataagccgggcgcggtggctcacgcctgtaatcccagcactttgggaggccgaggcgggtgatcacaaggtcagcagatcgagaccatcctggcgaacacggtgaaaccccgtctctactaaaaatacaaaaaattagctgggcgtggtggcgggcgcttgtagtcccagctactcgggaagctgaggcaggagaatggcatgaacccaggggggcggagcttgcagtgagccgagatcgcgccactgcactccagcctgggggacggagtgaaactccgtcttcaaaagaaaaaaaaaagaaagaaaaagaaagaaaatgagaataaatgtatgacatattgaaactcaagaaaatggatatccttggttacacaaagtcatacagatggtaaaatggtcattggagactcagagcggggagggtgacagaggagtgagggatggaaacttgcctagtgggtacagggtacactattcaggtgatgactatattaaaagcccagacttcaccacaatacaataaaccatgtaaccaaaaaccctttagccctaaagctattgatttttttaaaaaaactatagccttaatggtgatattgcaaagaataaaagattaaatgccagtagtccaaatacccacaggttgaaaatagaacatgcttaaaaatggtacatttaaagaagctgaaaaccaaacagtaaaccaaatccaatgaaaatagaagtcatacaagagatattaatggaaaataatacattcaaaaagaatcacataatcaaggggatcaaaaaaaaagccaaaagtttttccttgtaataatgttaaaataatcttttacaaaattcagagaccaaaaaaaagtgtgagagagagagagagggagggagggagcacagtaatataaaaagaaaaggtattactactgatcctacagaagaaagaaattcaaagttatgagctacattattgcagtacatatttgacagtttcaataaaatttgtaaaaaacttgaaaaagtcacttaccaaaactgacatgagaagacataaaaatcggaatattcctgtaactatttttaaaatccataataaataactttttctcatatatgtacaaaagttctaggtccagatgtttcactagagaattctccaaaacatattaacaggaaagaaaactaacattacttacatatttcccctattgaaaaatttctcagcttgttttataaggttaccgataattttaacatagaaatgtgacaaggacattagaagaaaagacagtaacagtccagtctctcttacaacctagctaaaaataatttaaatattatacataaaactccgcaatatgtaaaccacaaacataggttgggcttgttacaggaatgaacgtgttttaatattcaaaattttaaaactgcagtgtgtttttcttaacagaataaaagccaaaaatcatatgacattctctataactaaaaaaaaaaactccaaagtctatgagtgacaaagcctattacctaagttgcaatgatgaaaaaatatttaaattattaaaggctacctccaaaatgactgtgatgagcacctctgtaatggcaaagtgttgaacattttcctactgacattgggaatgagaaaatgatactgactatgatcaactttgttcaaccttacacctgacaaaattgctagtgagaaagtaaagaagaaataaaaaagatataagaacttgaggagaagtaattaagataatttttcaccaaaaaaatgaacaatttacagataaactcttatatgaatacatttacaaggtatgtgcctataagataatatttgaaatcaattgcatttcttttttaaggaaagaagaacttctaaaattgaaatttgaaaaaaaaagatacctctaacaatacatcagaaacatcaattatacaggaattaattttctaactagaatacaaaatctgaaaatgaaaacccagaaagcattatgagaaaattgttgaaagtcgggacattagttacctggaaaaggtaggcaagtattatcctaggaatgagtttaggagaattctgggttgtcagtaatagctaattccctaacctgcatggttatttatgtttattgcaaaatagtagcttactttttttaattttataatatccattgaatgtttattatgatatacccattgagatctatgtttatgatttgtatattttttaggggtgtgaaacaacaataaaacatttatttgaaagaaaattaatgaataacagtaaattttattatgacatcagatgatttgtacatctgatagttcttgacatatcatctatatttgaatttcttgtttgaataatttctctaaaaatgtttttagtaccctgctttgggtagcaaaccacttgagggaggatgagtctgggaatattttttaaaatgctctcaatgttcaacagcatttcatttggatataaaattctacattatagctgttttccttctataatttttttataaaatatatttccataggttattggggaacagatggtgtttggttacatgagtaagttctttagtggtgatttgtgagattttggtgcacccatcacccgagcagtatacactgcaccctatttgtagtcttttatccctcacccccttcccaccttttccccttgagtccctaaagtccattgtataattcttatgcattttcatcctcatagcttagctcccatttatcagtgaaaacatacaatgtttgattttccattcctgagttacttcacttagaataatagtctccaatctcatccaggttgctgcaaatgccatgaattcattcctttttatggctgagtaatattctatcgtgtgtgtatacacacacacacacaccacagtgtctttatccacttgttgatttatggtcatttgggtaggttccaggtttttgtaattgcgaattgcgctgctataaacacgcatgtgcaagtatctttttcgtgtaatgacttattttcctctgggtagatatccaggagtaggatttctggatcaaacggtagttctacttttagttctttaaggaatttccgcattgttttccatagtggctgtactagtttacattctcaccagcactgtagaagtgttccttgatcaccgcatccatgtcaacatctgctgttttttgattttttgcttagggctatttttgcaggagtaaggtggtatcgcattgtggttttgatttgcatttccctgatcattagtgatgttgagcattttttcatatgtttattggccattatgtatatcttctttggagaattgtctattcatgtccttagttcacttttgatgagattgttttttttcttactgatttctttgagttccttgtaggttttggatattagtcttttgtcagatgtatagattgtgaagattttctctcactctgtgggttgcctgtttacactgctgaccattccttcagccttgcaaaggctttttagtttaattatttcccacctatttatctttgtttttattgcatttgcttttgggttcttgtcatgaaatccttgcctaagccaatgtctagaagtgtgtttccaatgttatcttctacaatttttacagtttcaggtcttagattcatttatttatttgtttatttatttttgagatagagtcttagagtcttgctgtagccccaggctggagtgcagtggtgcaatctcagctcactgtaacctctgcctcctgggttcaagcgagtctcctgcctcagcctcccaagctgggattacaggcacatgccaccacacctggtttacttctgtatttttttagtagagatggggttttgccatgttggccaggcaggtcttgaactcttgaccttaggtgatctgcatgtctcagcctcccgaagtgctgagattacaggcgtgagccacagcgcccagccagatttaatttcttaatccattttgagttgatttttgcagaaggtgagagacgaggatccagtttcatttcctacgtgtagctagccaactattccagcacaatttgttgaatagggtgtcttttccccactttgtgttattgtttgcttagtcaaaggtcagttggctgttaggtattagggtttatttctgggttcttttttaatatgccattaccttcttgcaatccagttgcagtaaaagtttgatagaatgctttggtcctctgcaggtgactatttattctcggttattattatcttatagttagaattttgttttgacttaaccgaattggcttagaaacagaaggcacattattttcaagagcatataggatattttacaaaataaaacaaccatatgctggctgtatagcaagtcacagtcaatttcaaggaatttaaatcattcagattatgtcctctggccaaaacatctggagaaaagcaccacattttgtttctttgtttaaaattctatagagcatatatgtataatttctgttatttctgataaatgtaagatagtgttaaagtggtttagtacttcttttctgtcctccttgcacagtcacccttactgtttttggatttcttgtggtttgtgttgtgacacaagcctaatttttcctcaggttttaaagcctgctacttgtttctgaagtactgagtcattgctcaagcgaatattttaatatatatatccatatcttatcatttcaccaaatttagatagttaaaaattttcaaagatgacattgatacatttctcccagtagttacatttattatgccttagaaagcaataagaaaaggactaaaaaacagactgggatttggcaattcaggaatcaaataattatgttttaaaaagatattgtcgattctcctgcctcagcctcctgagtagctgggactacaggtgcctgccaccacgcccggctaattttttgtatttttagtagagatggggtttcaccgtgttagccaggacggtctcgatctcctgacctcgtgatccacccgcctcagcttcccaaagtgctgggattacaggcgtgagccactgcacctagcagagcttacagtgagccaagatcgcgccactgcactccaacctgggcaatagagcgagactccatctcaaaaaaaaaaaaaagaaagaaaaataaataaaaagatattgtctaaagaaatgtagacaagcatgacatttgtcactacaatgcttattcttcacaatttagacattgattaggtaagggttatgagagcaggaatgaaatagagacaaattaaaataatatgaatgtaaacttaaggttgactgtagatttccaaaccaaagaaactgttatttattataatgaaaaatgaagaaaaggtgcaaattgtgagtgaagtgaatttacaatagacgaaaacactgagccaagggaatgtctcccagactcaaaatcatgaaataaaatgagccagtgaatgtaacagtgaaaacttcaaaaatttgaagcagaactgtaaacctgctatgtcacagaagacaaaggcttccatgagtattggctatagcaaataagcaattacttatgaacataaagaataactgacttgggaaagtaatgactattatttcctagttcctgaatatttctgacaagaaaagcaataatttggatcaaccgttatattttgataaatactttactttctaattctacatatttctgcatttcaatttaggtgggatggctatagtaatttttaaattacctattatttcttttctatctagttgaattgtttttgaagtcaaagtcaaacctcttttgactttatgtatgccatctagttcttactgaggagcatcggcatgctgctgaaacctctatttaaattacctatttttaaagtttttctaaaatcctttcatgaatattatttcttttactagaagtaaaagaaatatgtagaagtgtagaagtgttactacatcacacttatgtagaagtgttactacatcacacttctcaaaaaattatataccaagaaatacagctgggcacatgcacaaagcaatgcagtagtatcaaggaaggaaattgaggaagaaatacatatatctaaaacaatccttcattaaaccaagataattaaaagatagactaaatttaatgaaattttaaaatcacatattactagatgatgactggaaaagaaaaccttttgaaaaataaagactcataattttgaactactttatattgaattagaagttcggttaacaataaccaaccaagtaaattttagtaattgaaatgaagtaccagaaggaataagtcaagaaggaaagcagagaaaatttaggataattaaagaaaattatgattcaaagttaaataaaatttaggcattgagtctatgtaaatggaatagaattaaatagtaaagagaacagaatgtaagcaataacaggtaaaacaggcacaaggccggtcgcgatggctcacgcctgtaatcccagcactttgggaggccaaggcgggcatatcacgaggttgggagttcgagaccagcctggccaacatggtgaaaccccatcccaactcaaaatacaaaaattagtcgggcacggtggcacgagcctgtaatccccactactgtggaggctgaagcaggagaatcacttgaactagggagtggagtctgaggttgcagtgagccgagattgtgccactgcaccccagcctggatacagagtgagatttcatctaaaaaaaaaatagtagcttaatgttatattttaatatcaaatggaagatacagaaaagaaggatttttttaaagaaaaaataattttatgagacctctttatagcccacttacagagtaaatatgtcaaagaaatgtttgccatttggttgtttttatgttttggtcccattgttcaacacgaaaaaggaaaataacatttgcacaaaacaattgtacaagtcattttacatgaaaattcaaattatagttaccaattggcttttgcttacagaaaaagaagtttagagtagtataaagttttgataatatgggaatataactgtaagtaaatgtgttggttaagctctatagaagtggttcatcctttgagaatgtcaataaatgctccaggaagaacttttttatttaggaagataaaatataaataaactaaaacactaaaatatgaactaaaaacaaaagtgtgaaacaactgaaaagttgaaaggagtatattagtaagtggagagggaggcaatttgatggggatatttgaaaaagttggaggatacatggattgagagaaagaaaatccaggatggaggaaaactttaaaaacacttgaaaaccacatagaaaacacgcaagaaaaatacgaaagaaaatataaaaccacaactgagaactataactgaaattataatcatttttcacaatataataatatatgtttttaccaacccttggaataaagtttaaaatttgaatttatttatatagagaataatacacaaccttacaacaaaatatataatttaaaaatcctacctatttgatttgaaagacttgtagaaattaacaaaattattacgtaggtttgatttctcatattttttacttaacattaaactcaattattttctaacagttttgtacatcaaaagtccaggcagactccaccagtttttttacttaggaactcacagggtgatactgaagatatggctaactttaagtttttatctggaaactaggggaaaagtcacctctaagctcattcaggttgttggaagaattcagtttcttgtgattgtagcactgaggctcacatttcctctggatgtccacttgggattgcacaagctgctagaagacaccctttggttcttgcatgtggcccctttctgtcttcaaaggcagcaacaatacactgaacccttcttgtgattcaaatcactttgacttctcgggctgcaagccaggtaagactccttttttccttcttttaacttttatttcaggttcagtggtacatgtgcagatttgttatataggtaaactcgtgtcacgaggctgtggtatatagaacatttcatcatccaggtactaagcatagtacccagtatgtattctttctaaatcctctctctcctgccttccaccttctagtaggccccattgttggttgtttctgtccacgtgttctccttatttagctcccacttataagtgagaacatgcagtctttggttttctgttcccgcattagtttgctaagaataatggtctccagttccatccatcttgctgcaaaggacatgattccattctttttatggctgcatatattccgtggtgtatatgtaccacattttccttatccaatatactgttgatgggcctttaggttgatccatgtatttgttattttgaatagtgctgcaatggacatatgtgtgcatgtatctttatggtagaacaatttgttttcttttgaatatatatccagtaatggtgttgggtcaaatggtaattgtgtttttagttctctgaggaatcactacactgcgttccacaatagctgaactaatttacacacccaccagcagtgtgtaagtgttcccttttctccaccacattgccaaaatctgttgctttctgattttttaataatagccattctgacaggtgtgaaatggtatcttgctgtggttttgatttgcatttatctaatgagtggatgttaaggtttttacatatgctcgttggcagcatgtatgtcttcttttgaaaagtgtctgtgcatgtcctttatccactttttaattagtttgtttttatttttattttttggcttgttaattggtttaagttccttatagattctagatactagacttttttcagaaggctacttcgcaaaaattttcccccattctttaggttgtctgtttactctgctgacaatttcttttgcagtgcagaaactctttagtttcattagatcccatttgtcagtttttgcttttgttgcgattgcttttagcacgttcatcatggaatctttgccagttcctatatccagaatggcatttcctaggatatcttccagagtttttatagttttgggtttcacatttaagtatttaattcatgatgagttgatttttatatatggtataaagaaggagtccagtttcaatcttcttgcatatgactaatcagatatcccatcaccacttattgaatgggaacttctttctttattgcttgtttttgttggttttgttgaaaattagatggctgtagatgtgtggcattatttctgggctctctattctgttccattgttctatgtgtctgtttttgtactagtgttatgctacttgggttactgtggccctgtagaagagtttgaagtcatataatgtgatggcttcagttttgttctttttgcttaagattcccttggctatccagggtcttttttgagggctaggtgaattttaaaaatagattttttctagttctgtgaagaatgttgttggtagttctatagcaatagcattgaatctgtaaattgctttgggcagtgtggtcatttgaatgcctaaatttattgaaggttatttaacatgtagcagtgttgaatgcatctattgtgataatcatgtggtttttgctttttatgcatctattgagataatcatgtggtttttgtctttagtttacatgattaatcacatttattgatttgcatatattgaaccaacctttcgtctttgggataaggtctacttgatcatgatgaattagctttttgatgtcctgctgcattctgttcgctagtattttgttgaggattgttgcatctatgttcatcaaggatattggtctgaagtttttttttatttttttattttattttttattttgctgtttctctgccaggttttcatatgaagatgatgctgttctcatagaggatgatgctagtctcatagaatgagattgagaggagtccctcttcttcaattttttagaatagtttcggtaggatttgtaccggctattctttgaatatctactagaattcagctgtgaatccatctagtccttggcatttttttttggtaggctatttattactgattcagttttgaagctcattattggtctgttcaaggatcaatttcttcctgcttccatcttgggtggatgtatgtgtccaggaatttatcaatttttcctacattttctggtttgtgtacatagaggtgtttaaagtagtttacggtggttatttttttttttctgtgggatcagtggtaacatcttctttgtcatttctgatagtatttatttggagcttctccttttcttaaaagtctaggtatccatatatctatttattgattttttcaatgatccaactcttggatttgttcatctttttattttttttttttatgtctcgaacgccttgatatcagctctgatttttgttatttcttttcttctgctagttttgaggtttgtttgcttttgctcctctggtacttctagttgtaatgctgggtttttagtttgatatctatcattttgatgtgagcatttaggactacaaatatccctctgaataccactttagctgtgtcccagagattcttgcttgttttatctttttgttattttcaaagaatgtcttgatttcttccttaattttattgttcacccaaaagtcacttaggagcaggttgtttaatttccatgtaattgtatggttttgagtgattttctttgtactgaattctgtttttattgcactggtttttttttgtttttttattattattattatactttaataataatagggtacatgtgcacaatgtgcaggttagttacatatgtatacatgtgccatgctggtgtgctgcacccattaactcgtcatttagcattaggtatatctcctaatgctatccctgccccctccccctgccccacaacaggccccagtgcgtgatgttccccttcctgtgtccatgagttctcattgttcaattcccatctatgagtgagaacatgcggtgtttgggtttttgtccttgcaatagtttactgagaatgacgatttccaatttcatccatgtccctacaaaggacatgacctcattattttttatggctgcatagtattccatggtgtatatgtgccacattttttattgcactgttgtctgagagtgtcgtttgtatgatttcagtgttttttttttaaatttgctgaagattggtttatgtctgattgtgtgttccattttacagtatgtgtcatgtggtaatgagaagaaagtatattttgtcatttttggatagagcgttctgtagaagtctattaggtccatttgatcaagtattgagttcaagttctgaatatcttcattaattttcttccttaatgatctgtctaatactgttagtagggtgttgaagtcttccactattattttgtagaaatctaagtctctttgtaggtctctaagaacttgttttacaaatctatgtgctcctgtgttgggtgcatgtatatttaggataattaggtctttttgtttaattcaaccttttaccattatgtaatgaccttccttgtgtttgttgagttttgttggttcaaagtgtgttttgtctgaaattaggattgccacctctgcttttttatgttctcctttcgcatggtagattttttttccatccattcattttgagcctatgggtgtcattgcatgtaggatggggctcttaaattcagtataccattgggtctttttctttatccagcttgccactctgccttttctttgaggcatttaggccatttacattcaaagttattattgatatatgtggatttgatcctctcatcctgttcttagctgattattatgcagactggtttgtgtggttgctttatagtgtcactggtctgtgtacttaaaggtgtttttgtagtggctgataacagtctttcctttccatatttactactcctttcaggaactcttgtaaggcagtctggtggtaatgaattccctctgaatgtgtttgtttgaaaagatcttatttctccttcacttatgaagcttagtttggctccatctgaaattcttggatgaagattttttttctttaataatgttgaatatagacccccaatctcttctggcttgtaggatttctgctgaaatttctgcttttagcctgatggggtgccccttgtaggtgatctgccttttttcattagcttactttatcactttttcattcattttggccttggagaatctgatgattatgtgtcttggggatggacttcttttttagcatcctgtaaaggttctctatattctttgaatttgaacgttggcctttctagagaggttgacgaagttttcatagatgatatcctgaaatatgttttctaagttggttgctttctccccatgcgtacagcacaccacagccaccatttagagaaaagccccatttcttgctgctatgggcccttgaccccctgttccccaacaagcagagcctctagctcaggcaagcagtgcagctgcttcaccctctggctgaacactcccagtagcagcagctccacatttctcagagatggagctcccaggggcaaccaaaagtccctctgccactgcctctccagtttaacttccctgtttacccttgaactagggaaggagcaaagactccgagtgctttatcccgcaagttgtagttgctctaatgagaggaggccagtctgtctcccacgggtcctacccacattctctgctagtcaccagacaggatccccccagcgtgggctcacagtgcagctgccccatgtcaggctgatcatgctaattgattgcagttctgcatctttctgcaatggagccccaagtgacaagaaaagacgttgagccacagggtctcctctgctgcttccaagctggggaagtaacataaagcctatgatcatttcagaactatggtgtgcagcctggatgcaccaagccaagatctgcagtgagcactcaagtgggagaggagcctacactgactttcaaaacattgagaggaagcatagctgcaacccatgaggaaatacggaggagccacatgactgagcaggagcctacacagtgaccattacacttcagcaccagctactagatcacaccccaaaacttcaacaccaataatactttgctatcataccctgctgtgaaaagaaagacaagaatttagctacaaataaaggccctaaacaaagccttaggactctgaaaacatggaaagaagtctactgactgtactcaatttacactgcaattaaaggaacacccacacacacacacacacacagatgagaaagaacctatgcaagatctctggcaactcaaaagaccagcatgtcttctttcctcccaaagatcacactagttccccagcaagggttcttaactaggctgagatggctgaaatgacataaattgatttcagaatatagataggaacaaagatcattgaaattcaggggaacatcgaaacctaattcaaggaagctaagtgtattagtctgttatcaccctgctataaagaacttctgagactgggtaatttataaaggaaaaagatttaattgactcatagttctgaattgctggggaggcctcagaaaacttataatcatagctgaaggtgaaggagaagcaagtaacttcttcacagggtggcagaagagagagagagtgaagggggacagtcacttttaaaccatcagatctcatgagaactcactcactatcatgagaacagcacgggggaaccaccaccatgatccaatcacctcccaccaggttcctctctcaacacatggggattacagttccagataagatttgaatgggaacacagagccaaaccatatcactaaggaacaaacacaaaaaataattcaggtgctgatcggtgaaatagccagtataaaacagaaccaaattgactggctagagttggaaaacacaccacaagaatttcataatgcaatcacaagtattaacaacagaatggaccaagttgaggaaaggacctcagagcttgaaaactggctctcagaaataagacagtcgggcaaaaataaataaaattttacagagctcattgtattagattaggtacacttggataatcttcctgtcttcacatcaactgattattaacattaattacatctgcgcaatccattttgccatgtaatacaatataatcatcaaagtaacactgggaggctaaggtcatgaccatctaatattctgtataccacacaattgtattgctttctgaggtcactgaacactttcagaattcatgaaagttggatactcactataaataagatagatatggctagcaagaagaaaaatatagggattctatacttaaaagatacagctatttccatttatataattgtcacaataaaaatttaaatgtgaataagtgaatagcaagtatagaaagtttagcaaaataatgagaattagatatgtaaatgaatttttaagatagtctcagaaaaagtgtaatatttgtcatttatcctgaaatgtcaaaaattttcctaagcagaactactcaccaccaatttctcagtttcatccctgaaaaaaaaatcattcaagtggatttattttggcaaagtgaaactgtgaattgcttggctccagaacagctgcccatactcagcaggactgcattcccacactccattcacccttaccccatcccttccaggaacacttggactaggatccagctctagatctgcaagaagttgtgttccagctcttaaatcattagtaggaccagattttactcaaaaaactattctagcatttgaaattatttccactgctttgttgcttacactgaaatcgtccctcaaaaaatataagaaatagaatatgagccctgcttattctttaggacaaaatttaggatggtgtatctaataaatggattgtaattaggaagatggttttacatttgtccctagattcttctgtttttctcaggcctctatgaatctttctctctgagagatcccgacttgctgagagcaagaactattgaaaggaaatgaagtaaataactgatggttgcccatggcaattaggaaaataaagagcaaacttccctctttgaatattacttagtgtcaagacttaattatactcattgactatacaagtctaaatatttgggcacttatatttttgtatttgggcatatgatattacaaaataattttgagagctaagagacatacgtatgtattttagaactccaatagcagtaactttctcagtagcatatagttttccaatctgttggaaaaagcttggctttaactaggagagataagtaatagagctagagtttcaattctgttcaatatgaataataatatttcaccagtagaaattaaatatgtataatcatgtgacagtaatactgatatgatctgagaaatgcattattaggcaattttgtcattatgcaaacatcatagatgtttacaaaaccttgacaacatagtctgctacatatctaggctatatgagatatagcctattgctcctaggctacacacctgtacagcgtgtgactatactgaacatgtaggcaattgtaacataacggcaagtatttgtgtatttaaacgtatctaaacatagagtaggtatagtaaaagtacagcgtaaaagatgaaaaatgttacgtctatattgggaacttaccataaatggagcttgaagactaaaagttactctggataagtcagtgagtgaatggcgagtgaatgtgaaaccctaggacattactgtatatgactgtggattttataaaaatgatacacttaaggaccatgaaattaacattatcttactataccttttaatctaatatattttaacgcttttatatgtttcaacgctttgattttttataataacatttagcttaaaacacaaacacattgtgcagctatacaaaaatatcatcttttatagctctgttttataagattttttcctttttcagctttgtacacctttttgttaaaaagtaaaatgcaaacacacacattagcctaggcctacacacgatcaggatcatcgatataattgtgttttaccttcacacctcatcccactggaaggtcttcaggggcaataacatgcatggacctgtagtctgctgtgataacaatgccttcttctaaaatatctcctgaaggacctgcctgagacagtcttacagataattttttttaataaataagagtataccctaagataacattaaatagtaaagtatatacataaatgagtaacatagtaatttattatcattatcaagtattatgtgttgtacataattatatgcactattcttgtctatgattggcagcacgataggtttgtttatatcagcatcaccaaatgcacttgagtaatgcattgagctttgaagttataatggctattatgtcactacatggaagatatttttcagctccattagaatcttatgggaccactattttaaatgcagtctgtcattgaccaaagcattattatgtggggcatgactgtaaacgtttcaaagaaattggttttccctttcattctattactgttccaccactagctgttttgtacgtttctctttctgtgctgttccttaaatgtagaactcctctaaatgtatttcttttatttatcctgtcccagaacaatctcattaacattccttggaaatgtttcctctcatcaggaatgctcttctgaggcctgtacctgaatgaccatttgtccccattaagactcatttgggggcaagtaacataaatggaaaaaaaaagtagactaaagtaactaagcccaagggtagtatgatttaagctaaaggtgatttcaggctccaagtaaagtaatcagggttcagcttatctccatttgttatctcttcttctagtgggttggacccattttcaaagaatcccttcccttacatagcagtccatatagaatctcacttcaaatacagtttaaagaaaaaaaaaattatcttcaaaggcaaaagcaaagtctggaaccagatttccattgacccagcctggatgctggtattggatgctctattacgcttaagtgagataaatagccatttctggccctctttttatttgtttacaatgccccactttggagaaatgctggagtgcatttaagaaggttctattcatgaatagaagaatctcagttgtatagaaaatgatttatttgaaattacctgctataaaaacttcccaggctcattgctttttggatcaactctgtctcttctacttccttgtactgctgtctggaagaaccctggctcacaatggtgcagaactttttatcctgatatctgaagtaaattgatctgagtttatattaggttggatcttagtgcccatattatctactgggagtttcccagcctggtatgatggagcttagaagagagtaaattagcttttacaagtcagtctctcaatatttatttagtgagtgagtggacaaatgaatgaatatttcttggaggtattattcattttgtgttcccttcatacttcaaattattttttacctttagtaagaaatggatactgacatggctttaatgaatctcctccaaaattcaagtgttgccaatgtgatagtcctaagaggtcaggcctttaagaggtgtttaggccatgagagatcctctctcatgaatgggatgaggtgatcttataaagggtcttgacagagagagttggttctctcttgccccttccaccttccaccatgtgaggatgcatcaagaagacctcagagcctggtatcttgatcttggacttcctagccaccagaatggtaagaagtaaatttctgttctttataaattactcaatctatggtattctgttttagaagcacaaaatggtctaagacacataattttaccctttctaaatccaaattgaatgcaattttatcataaagttttatcatttctctaataaaaatgtttttaaattttttgaaagtccacaaatgcatatatatttacatgcatatctatatgaaggtccaactttgattctgctttgttttggctttcttttttgtattacttttctccaaagagtaaaatacacacttgttttattctcttattcctacagcacctaacataattcttactaaaaaatattatttaatgaagaaaattattatataatacattttgttgatacattattttctacatattatgtgtcaattttgttccttactatcctcagctggaatccatttgaagagacagaactgtattgtgtagattcaagcaatacatagtaggataccatacatactgtagggtttggctctgtgtccccacccaaatatcaccttgaattgtaatctccataatcctcatgtgtcaagagcaggaccagatggaagtaagtagatcatgaaggtggtttcccccatgctgttctcattatagtgagcgagttatcttgagatttgatggttttataagcatctgacatttcccctggttgcactcattgagtcttgccaccctgtgaagaaggtacctgcttctcttgcattctgccatgattgtaagttttctgaggcctccccagaactgtgagtcaattaaacctattttctttatagattactcagtctccagtcttgcgtatgtcttcatggcagtgtgagaatgaactaatactcatataatggatactaacaagtaaatctttatttaccacttattagaagcttgacttaaccaattatcaaattttatataagctttaatgttattgggaaatatccttttcctgtaaaaataaatgagattacctacctgaagtaccttaggcctttctaatattttcaattttcattaaatgtttatttttatgtatctatagatatcttgaatatgtattgtaaatattatatgtatgtagaatatatgtattctagtatttcttccagatagcacttaaaaaccagtgtttgcatttttgcatgtgagcaagcaattcctacttacaatgatggaagaaatagataccctggaagaaggaaaattaaattcatgctttcaaagcatccttcccaacaaatccaattcatcttttgcacagaaggaataattagatgaagatatattttaagtcagattgttagtattttggccacatggctacatcataagtgtagtttaaaattctgttcatttttatttttttaaatcaaaacactcattgaactgtacttaatttttaaatgcaaaatacataaaactcttgcatttcttggaaataaattctctttattctactaataaataaacattgttaccaccattgaggcaaatgacagaaattcttacaattgattatcctatatgggtatgaaaactttaacatgctcctctaagtaactgaatactacagagtgattttggatcaatgtggccttattttgaatataacatacaaaatcattgagtgttttatgatttatcttcattttaactcaagctttgggatatatgaagacagaagataaatcaaaatgtgtcacgtattatattttctgaagttattaacatatatctagcaaaaggtaaaatagcacagatataccaaccaaattttcatgtgaagaaaatattttatataaataatgtttcttcttttatatgaaatcactgcaaaaatgagaaagctactttttatattccccaatgaatattccccagtgctgtgattccaagttcagtaaaatttagaaaatcatggccaagaaatttagtagaccgaatgtaccttcactttctggaatgtacttgtaaccctacattcacagttagaaatttgcttgaatgaaaaagtgttcaaagtaattattatcttgtatttggcttctctgggtacctgtttggcttttatttctaaataaaaaaacaaaacatgcacaatgtaaatatttttagtttgtaaaattttctttccaattacatattttgagatgttgtatatactgtaaacattttgaagtaattttgcccaaattaagaaaaaaaattcattcatctttttatcttatttttattttggttcacttttcatctgggtattaatatggatgttgcagaaagaatagctcctataaatgataggttgctgtatggatatgcaacaaaaccatctttattttacagaaaggtctcattactctaaaagaaggccagtgaagaaatttatattgaccttttggcatgacctttctaaaccaactgttccctagtacctaaactagtgagtttactgcatagagacacccaaaggagtaaaacatgaagtgggagactttggccctattagaaaccttagggccaggttctgttccttatcacctatgagatttcccttgttaatgatgctgagttgggcatatttattttttagccatttcatcaacaagttttgcttatgactaaggatgtcatttcttgttcccatcacatggtgttttaggacattcctgctgctttaacaaaatatcttacttagagtaattcataatttataaaaattccttatacattctttatagattctgacaattccataagtgtcatgaatttcagtagggaagtgacttttcaaagtgagctctggacaggtagccataagtaagactacggtggcacggatatgctgtgctttgatcagttgtgtggtatgcaatttttattataaatatcactgaactccatatgacaaaaattactcatcaacttttcttttttttttttgagacggagtctcgctctgttgcccaggctggagtgcagtggcgcgatctcggctcactgaaacctccgtctcccgggttcacgccattctcctgtctcagcctctccgagtagctgggactacaggtgcccgccaccacgcccggctaatttttttgtatttttagtagagacggggtttcaccgtgttagccaggatggtctcgatctcctgacctcgtgatctgcccgcctccgcctcccaaagtgctgggattaaattagatgtaaaatgttgttcaggtttattaaataaagaaagaaaaagattgttaactagatgtcttattttgtttttctctgacaacagctgtcttgtaaattggtatatttagatcatgcacatttaaagtaattattgggtggtaaaaaagttgggctggtatttattatgtttataactattttctattcatatcatttattctttgcctcccaacaatcactctttttcttatttctattgttttaattgacacttaaaataatcccattacatttcctctcctagcatgtcagttatactttagaacagttttagtgatttatgtgagtttgcaatacacatttttaactaatctcaatctacctttaaataagactttgaataactcaacacaaatatcactttacaagagtgttacagactcaatatttgtattcccctattcccccaaaatgtgtatgttgaaacctaatccctatggtaagagtatttggagatgggtctgtgggaagtgattaggtcatgagggcaaactgttatggatagaattagtgcctttacaaaagaaaccctagagagctaatttgctcttctgccgtgtgaaatcccagtgacccatcctctatgaacaagcccttgccagacacttaatatgcacatggcttgaccttggacttcccagtctcagaactgaaaactgcatttttgttgattataagccacctagtgtatggtatcctgttataaaagcctgagcaaactaagatacaagtaatcccaattcctaccattatttatgacactactgccatttaatgtattcatttatatactatattcattcaatacattgttacagttattccttttaaacaaaatattatcttttaggtcaattaagaataagaaaataaaacattttattttagtttcattcattccttctatgatattcttcctttctttatatagaccaatttctgacctataccctttttcttctccctaggaacttctttgaacattctttgcaaggcatgtctactgaccataaactttctcagtttttgtttgtctgagaaggtctttatttcttctacactattgcaggataattctattagatatagaaatgtaggccagatgcgatggctcacacctgtaatcccagcactttgggaggccgaggcgagcagatcacgaggtcaggagattgagaccatcctggctaatacagtgaaatcccgtctctactaaaaatgcaaaactaattagccaggtgtgatggcatgcacctgtagtcctagctactcgggaggctgaggcaggagaaattgcttgcccaggaggtgggggttgcagtgagccaagattacaccactgcactccagtctccaaaaaaaaaaaaaaagaaaagaaatgtagatggtgtgtgtgtctctgtgtgtttcactttcaacactttaagtatttccccccactctcttcttcctttcatctaatgaaaaaccaactgtaattcttagccttatttatttacaggtaagttttcttgtttacccttggctcctttcagtatgtctctctgtctttgattttctttggtttaaaaaatatatacctaagtatagatttttgacatttattctgcttggtattctctgcacttcttgaatctgtattcagtatctgctgttaattttggaaaattcttagccattattactttaaatatttatttggatctgttcttcctttctttacattctggtattcagatgtacctgctaatagtctactagaaagaaaataaaatataaaattgagtaaaataaaacaaaataaaataaggagtagcaacacaatgcattaaattcaatgcaacggattaaatatgttttgatctgttaaaaaaatcaatctgaacaatgatgtggtttacagttagtatgcaatatagaactctgaatttaattgtttttatttttctacagtggttttacagtaaaaataatttgagtttaagtttggattgttacttttaaaaacagagctaattagcattgtttattactttctcaccttaattttcttatatatatatgtgtgtgtgtgtgtgtgtgtgtgtgtgtgtgtgtatatatatatatatatatatatatatataaagagattatagatctgtaatgcttagcataagtcctggtaaattgcatctattcaatgaacatttgttctccctttaattcctgcaatctagatggtggttcatggatatagttgctctctaattttttgagcatattaaggacttaaaagctaatgatggtgtattgttatgtcaaggccagcagagcatatcactttaaaaaactggcaatagaaacttctctttaaaaattgtaaaagtaagtaaagtttagaaaccaaccaagtacgagcaatgcaatgttagcatctcattggttcacaccagtgaaaagtatttaagaacaaagaaatggtatactgtaccacacagaaacttgcatgcaaatgtttattgcatgtgcagctatattcttacttactaaaacttagaagcacccagcttatcctttaataggtaatcattccttaattagataaacaaactctgctatatccatacaatgacataattatcaggggtaaaaaaataagccatccagtcatgattagacatggaggaaatttgaatgcatatttctatgtgaaagaagccagtctgaaaagtctacatattgtatgagtccaagtatataatcttctagaaaaggcgaaactatagagctagtgcaaagtttagtcattaccaggagttgggcatgtgggggataagtaggtggagcacagggaatttttagggcagtgaaattattatctatgattctgtaatggtggatacatgacatcatgcatttagcaaaacccatggaactgtataatacaaagagtgaaccctaatgtaaactctggtctttagtcaataaatgcatcaatgttggcttcttaatgcaatttcattttaaaatataaattttcttattttttccacatatttcttaggggaaaattttaaataatttctagcttcactgttttctaatggataaaagcataaattaaatatgcttttattactgagaggatatgacattgtagtaacagatttattaataatcaagaatgtattaacatatttatataaggtaacattctgtggatttttgtttccaaataactcagaattgacaaaataaaaatataattattcaatgatgaatatcacaatgagcaatattgatctatttcataaacatttcatcctgtcaatcacagggatactcagttcaaatacatcaaaagaaaacattcttcaggtaaattgaaattacaatagtttcaatttttacaaaagtttagatgttgataacagtttcagagccacttctctgtatagaaaagctttctggggatgtcatggttgtaactaaaaacaaaaatacagatttatagataacaaaatgaagagaaatctgttataaatattgattgtatgattatgaggtctttagaaattacaaattattttatcagtatattttaagtgtaggatatacttaatttgaatactaatatttattacatatgagcttaattgtgtctgttcaaaagatacaatgaagtgctaaactccagtaccttaaaatgtgaacttatttgataatagagctattgcagatgtcactagttaagatgaggtcaggtgagtgctgtccttataagaattgggcacagagatacatacatatagggagaatgtcctgtgatgacagagtcacaaactgatgcagttgcatgccaaaaaatgtgccaagaattgataactggcacctgaagacaagaggtaaagaaagattctctccttcaggtttcagagggagcatggtattgctaacatcttgattttgaatttctgacctccaaaactgagagaataagcttttgatgttttaagctacccagtttgtggtattttgtatgacagtcctaaaaaatgaatacaaatagtaaaccataagcaaaactacaagcatggaaatttaccctaattcactttctgcgtaacacttatgattcaaaaattgatattatattttgtatttttaattatctttctcacgtaggagaacataaacatcctgagggcaaaatctttattcagtttttattttactcataacacttagaacatcgagtggcaattgatgtgtttgctagtcaggatgttattctggtgaatactgttcattctatgtaacaagaaaccactgatgtatcagtagtttatgaaaggtttagtttaactgatgctacctatccaaaacaggcaaagcagtgggacttccccttcctgcgagtcaggtaaaatatttgatacatgttttcatagccacagagatggggggaaacagaacatggcaaagaatgactggactctaaaaagttttatattctggattagtcagaatttcaacagaaaacagttggtaaatacaactaagaataatttgaggaatgcttccatacaaaggaaggagcatgaaagaattgtaagcaataaatctggaactggcgctcagtgaggataaaaacaaaacatggaaaaagaaggagtagaagatcagaccacctggagaacaaaagtgaccttctgtaaagagacacatgtagggaagacagcctcatggggaagagaccaacagaataaacaccatgacccttttctcctcttcctttctgccttcttacagggttctccacaggctgaacctaacctgaagccagaggatgagggagcctcctaatgtattcgtgagaagtcaaaaaaaaaaaaaggccaatgagtcaggaagagtggaaagggttgcattagaagatattttacacattactttcctttttttatgttaccattataaagtgatatatctagaagcaatcttgcacatcaatctttatctacatctcagattgtgtaaactttatagcttactgtttccctcatgaaaagtaaagtatcccattgtaagagtaagacaatatacaactatgttatatagtgttaacttctgttaattgtttgtaagacaaattattggggtgattacatgaaataaggaggtctaaattaaactttcaatgacagaaaaccagcaatatataagaaacagaacaaacattcttaatgtatttaatgtatttcaatctgtgtatttagcatctacttataattttttaaacaatttaactctagtttttaatatagagaccattacaccatttcttcttatatttttaaattacattttatatcatctttatcattaggataagcaggggagaaatgttgaatatattgattgatgtatctgatatatacactcatgtgccacataattatgttttggtcaatgacagaccatatatgtatgatgttgacctcataagattctaatggccctgaaaaatttctatcatccagtgatattgtaagccacctaacattgtagcaaaatgtattgctactgtttgtggtgatgatggtgtaaacaaatttgctcttctttcagtgatactaaagtacacatacaattgtgtgcagtacatagtattagataatgataaactctgttactggtttatttgttttatatactacaatttttatcattagaattaccccttctacttatggaaaaacagttaaatctgtacaatagcctcaagcaaatctttcaggaagtattacagaaagaagcatcattaccataggaaataacaactccatgagtgtaattatctctgaagccttttcagtgggacaagatgtggaggttcagacagtaatattgattatcctgacctcatgttgacatagtctaatgtgtttgtttgtcttttttttgttttttgtttatttttacaagaaaggtttacaacataaaagaaaaaaaaaaaagaaataccgaagtggttccccaaggcaccaatttaaagtgtatatgtgcagtgcagggttactggaccaaggcacagtgtaaacagcgaaattttattttttgttttctttttcctaagatgttccttactcccagttacataaaaatgtgtattacaagcaaacaaaaattaacaggaatagaaataactataaagtatattcacattaaaatcagctttgctttatctattaaaggatgtaacacagttgtggttttcaggaccttgtaactcctggtgaattggaaagcacagaaattcttcagagcctcaagagttgtgtttaatgcattatttaaatagtgtccaaccactagttagatagcttaacactcaaatagcttttgaaatctctgtagactcacctcaattgaagagtcctgataatttacagaagtgtgtagtgcactaagagatccctgctgtacgatgcctgcctgtggagtgttttatgtgttgatccactggagtgtgtgtgtgtgtctgtgtgtacgtgggtgagtatgggtgggtgtggattgtgtgtatgtgtatgtatttacattgtggtatgtgtctgttggggtgccgccattagggatttggaagagtgaggaccataaacttgtcaacattcctacatgcctgcttcataacaagtgtactgaacatggccaaaataactaaaccaagtaaacaaattagacattaattaaatttaatgctgggcaggaaagaagtagtcaaggccaggtaaaatgaagaaatataaccaagtgaatgaaatttttacattgattcgtagaatgagacatgaatattttttaaaatttgtaatttctaatgactatcagtatataaaactaagaattatatggctgtcaactgactaaaaactgtacataagattagagctagtgaaacaaccatatatgaacttctatttccacttttctgtctcaagaatgacttgtgaaaatgatgttttttttgaaattttacattctcattttgaaagagcttcacaaaacttacgtgagaatctggatgctcataagaggtctgattttttaatggcatgtttgtatttctgttatgtacatcaatgtcaagcattcgtttcctgagctgttctctacaacacaatttaacttgtaatagacactcaataaaaggtcggttggatattcaaatcaacaccttagttccatcaattttcatttcatataaaaatgcctgatcttctatactcaccaatgaaacagagagagatgaaggagggagagcagttgagactgagaggatgacgagcagacctcattctgcagtggatttcctacactctccacttctgaatgcttggaaacacttgccatgcttagaaaatattggtatttcctaggcagcaaatgggagttaaagaaagtccatatttctatattacaataacttacactataatacacagacaacatacatttctaagctatttcaattcatagaaaatgtagataaatttaggtgagcaaggtgtaggagaagggttagtaatcaagctgagtgtgattgtgagattaaatctaatattatgcaattattgtataattgtatcagttgacatatctgttgaaacagaaggtgggagagttttgcatgcgcttccgaaatgtactggatgatgttaggagagaggcgggtcaacgtggctaggccataagtgtttactaattgaggcttaggaaagttaagttcctaaccagagactgggagatagaggcgctaaattgtataacatttatatttaatatatatttaataatatatagtaaagtcttaaaatgccaattttaagtcttttcattttcttcttaaaaacagaggttttattgcgtttggtccacagtcggtatttcacattatctcatagcgcagggcccctgggtggagggctctgtgcagtacttggcgtggcctggggccgggagagatagagcagtagacctggtcaggcccggaaggggagaaggagggccggggctccttaagacctactgagggcctgggcgcggtggctctcgcctgtcatcccaacactttgggaggacgaaacaggcggatcacatgagggaaagagttccaaaccagcctggccaacatggtgaaatcccgtctctactaaaaatacaaaaaatttaggcaggcgtggtggtgggcgcctgtagtcccagctactctggaggctgaggcaggagaatcgcttgagcccggtaggccgaggtgcagtgaggcgagattactccagtgcgcttcagcctgggcaacagagtgagactacatctcaaaaaaacaaaaacaaacaaaaagccctactgagggccacggaggtgggggagcaggatggagatgggtcaggcttaaccctgacaactcaaaattccactaccttgtacgggcctcagtttcctcaaggagccccagcgtaggtctgaggtctgttggtctgagggtcctagggaaatccagccgctcaggagcctgagatattttagcatcgtggctgagccccctctcccaggggacacacttcctagcaccctctccactgtccccgccccattcctcggggaaaaaaaattttttttattttgttaatacttcctgaaacttttgcgggtacagaaaccacttactgataggctgagaaaaggggaagaggagaggcaaccagaaaccttcagggaccggttccctccatgtccaggtctcttctctccagcacagctcagcctacagcctggaagtgccagcgggcaccttcaccctacacgcatcaggatatggccttgatcccttcccccacagcccggtggctcagtcctgagaaggaaccaaagcagggggaggtggggaaaaatccctgctgcctgatcccacgctgccactcacagaccctcggttgactggcagcactgaacaggtttaaaaaaaaaaagatgaaaacacagaaaaacccaaacacccagaggggagatcatgtgtggagagagcgtgctgggagcctcagtagccggtctcctcctggtagtaagggagatattcaggggccggagcccgagggagcgccgtgggccactgggcctccccagtagtacctggggtcgtatatctgtaggcccatgccgaaggcctggccgctctgatgagcgccctgcgtgtatcccatcttcagggacgtggaggagttgtcacacttgtcgattcccagcttggtgtcataggtgtgctcattactcctatctagctgtaagtttgtatttgttaaccaacctctccctgtcctcttctccctgttgctctccccagcctgtaataaccagaattctactctccacttccatgagctcagttcgtttttttttagctcccacatatgagtgagaacatgcaagatttataattctgtgcctaggttatttcacttaatgtagtgttccaggctgatccatgttgcagccaaggacaggatttcattatttttacggctaaatagtactccactgtgaatagatactacatttttaatctattatgtttttggacatttaggttgattctaatcttggctactgtgaatagtggctgctataaacatgagggtgcaggtatctcctaaatatgctgatttcctttcctgtagataaatgccccatagtgggactgctggaaaaagaaaaaattctttttctttaaacctgatcatgtctgtcctcataaatgcatgttacacccatctctcgccatcaatgcaacccgaccccgagcagttgttcactcttctcttccctcgttctcggcacaccgtgtgcctccataccccagcctcaggcctttctataccacttcccatttgaggcactgtgtttttattcaactttggtactgtcctttgagaatcttcaacgtgatttggatatggcactttttatcaggatgttacgtcagtgttgataaattcaaagtaatatcgttctttttcctgccaaagtcagctcctcctttccactgcactttcctgccgatgccaccactctttctcctgaatgttctcagaggacacccttgtacctggactggtcattacataggtgtaagttttattctctaaaaggggtgagtgagagtttatactaaggttgtaagcatccctcagggcagactctggatgtatattacagaactgctgaacttgtggaatgtgcatgtttaatactgaaaatatttaatgccacatgtgtaagacttttgccaactggaatctgaacatcaacaactttgaagggcttattctaccttctcggcacaaaaatagtttctacgaatgcacatatttatgtgcaaacgtatagaaaattgactttaaagtgtacaacaaatttattttagcaattgggcctgggggacctagaaggagaatgagattggagtggtaggggtggaacattagctaataatgatttattttattaaaagtaattactgaaaaccaatgcaataaaatattaacatgttacttgaaggggttgggagtatagtgcttatattcttctttacatgttttaatatctttaaaattccttgttttgcttttgctaaggaagtcacagtttaattggcagtatatctctaatggtacatgaaataatgtctgatttctaaacattgacattctacattagatgaaatatattaactattaagctttgatattacactataaaattaattgaagaaagccacccctctttgtttctttcttttttagttattatgtgccccatgtgatctgcaggagttttttttctaggctttgaacattttaaataaaatcagaatttgttcaagttcagttaacactcagctgtgaaccctatggtactggggtctttttcaatgggagatctctaagcattattccaaactattctatgctaattgatctattgataatttataatttattatgaaatacattaaatttcttaaaaagaaaaaggaaagaagtaaagggaaacatttattacaatttaaataaaggaattagcagttgaaaacaagaaaacctattctgagcatccatacttctcggcaaccaaaacaatcaatgaaatcaatgcattgggttaaacagttcccaattgcccactatgttaccaggagaaaaaaaccctttatcatagggttaaactttgggaaggattttccataaggatcttaatataaaggttcttgaatggcataatgtataaggtctttgatagcaacgctacccacagtgcaaagatgttttactagtcctgttggtgtctcaaattggctcttggtaagtaatctggacatatcgtgaaattataattctgtgtagacaattcgacttaccaggttagagtgatgcaatccaaatagatggctttcttctgatctggcttaacagaaatcttgaaaaatctggaggagtaaatgtttaatataccctcagttctcaaccattcttcttcccctgaaagacaacatcacaggcaggacatcctcccaagtgtacacgcaatattatgtacagttcccacgtgagaaagcacatcataatcttagtgagaatgatgttctcataaggtcagttatactcagtgtgcatagttgtccaagtgtgagtatgaaaccaagtcattcgcaagtaccactagtctgattattagtaataataatccacttgtgacatagtttttctttgctgaaataaaatattgttttgacaccatggttgaaatgttggtcttaggtcaatgctctctattatctgttgttgttgccaagcctctgagaggtgttttatgtggggcaaaaggtcccttcctgtgtctttggtcaaagcaaaggaggagtacagacgactgagagagtgatcacgctgctgtgcccacctatgcggtagaccttgttcctgggttgggagatgttttatgatcagggtgcagtagaaggagcacactagtagcagtaaagagaggtgaccctggctgcagttctgcctctaacttcctgagtgacctcaggctagtcacacagtgactgctccccacatttctttttgtaagctgcaaggattgaatcagacaatagcctctaagtttcttctgaactctcatactcagggatgccaacgatgttggtaataaaatagtatgaacatgccaaaaaaataaaaataaggaagagaaataggtatgtaactttactctgggactcctgtggtatctcacaacaccatgcttcatgaaccccaaagaaagcaaaaaatccagctagtgttataaatcctgatcagctgaattctttcacatgttgcagcctgactcaagttattcatcgcagaggctagcagctccctgatgcatccttccttgtctctggacagggtaaaaataagaaattggccattgtgagacactctgagtttcgtgggattgagcagagcatattttatattcttctcttggaactgcctcttgttggtagtaaatggttgccagcactgttgtttctcaatagacaagtcctagaaataaagataattcaattttcattcactcttagctcttctgctaccagtgttcttctttgacactgacagggctgcacctgtctccctggcctgacatagcacttgtatggtttgccacttgccagaaaatccacgagtcattctaaagaccttttgcccagcagagaccactccagtgagcacaaattgtctagtggttttttttagatggtcttcctccttggctcatttctctccaagaacgaaaatatcaaggtgttcatttaacagcagctcctgaaagacaatccagcttgatttaaatctttaacggttttcattataatagaaaatataatagcaacagtagcatcctcttttacattgaaattaaattgcaattctttcactgttggggtggcaagtataattcctatcacttctttggaaagcaatacaacttactaaagatcaccaaaatgtttatactttttggaaccaaaaacctcactgaaaaaagtttattccaagagtatgattcaacagaaaaaaaaaagtaatatacatgtgcatgtttctccctgtgaaaacaacagcacagaatttactagacaagttttgaaacagttggctatgtggtaacatggaacaacattctcctataatgttgaaggataaaagcttagagaatagaatatattctatgactgcaactgtgaaagaaaacatagatctacatagggacaaagatgataaacatgcgaaaacaggtgttagattcatggattatgtgtatttttcctgcattcaaatttatctttattattgcttttttatgttcccctctcctccccccaaaaaatcctaaagatcttgaatatgcccctgtcaatatttaacatttcttctgaaactgagtctagatactcaatctgctccagttttttgaacaagatgagtagcaaggttattctttccatttttttgtttgtttgtgttttttgtttgttttttgtttttttttttacagccagacacaggtcttgaattgtacagctgactgctttgtttgggatacgttactttcaatcattttcctgatcctctgcatgatttacagaagccgagtgggtggctttagcatttccatggtcctccctctccactatcatgacattcttaggtgaattttttttagagccattattctccatttacaaaggcagaatgcagtggcaggagctgggactctgggaaaccaacagccaagaattcaaactacagcatactatgaaacactcagataagatgtccccatcatattctattattgggcaaaataaaaggtaaaccatgtgctcaaaacagcaaatattgtgggtgacagtgacactggtattcggaaagatgaagagatgcaattaagaaacctggcaaagaagtaaacatgccatgtagcttacaaaagaccagccacattgtgtgtattttaatattgtttaacagtaacacctaataaagagagcatcatgattgtgtgaactacattttcggtcataatgaatgctacaaaattaacctcccaagtttagacaggctacaacgtcttgggaaatatgcaagaagaattatttgataaaggtgacagtttttcacacctgaaaatgatcttctcccagcctatcttgatcaacagccagcagcaacacattgcagatataatctcaagaccttgtggcatgtacttctcactacatgcataacttactatggacagaggatcatggagattttgaatataatttcccacatgacaggagattaaatagaccacattggaagaagctaggtctctggagaaccaaaaagtaaacttcagccagttctggaggcagataaacagcaggaaatgtactttcagatgggctactttctcaatagttctttcttgcaagagctctagggaaagtatgagttactgggtaagaatgtaatagaaaaggggccagccttggaaaactttgcaatggaagaaaatcagtgtctcctcatttacatctttctttctcctcttcctttgtaatgccacctttcttgggatattccttcccctagaataccctgcctgtcaccccacgagaacctgctcttgagactgcatttctaatacctataatgagatgttatgtcaatgccttatctctcagtgtgtgtatatacatattaagctttctgtctatgttgtgctttctcatgcaggaatatcagacattaatgaaccagtaaagaagatactgaggtgcagaagagctttcccagtgtcccgggagccattctacacagcatcctacagaatgactgtggatctgctgtgcttagtttctttacttgtgaaaacagagtaatagcagcacctacctcacagggttgttctgaagattagaggggttctttcatgggaagctctagagcagtgcttgagacatggtaagtgctcaacatgtgttcattattattatcattatcaatatttgatgtaaaagcctttctgaaagaaatcacacaagaacatgatcagttaaaagatatatatgaatgaaagtatgtttggcgctgtcacaacacagagtgacataatggttaggaacataggctttggaagtcaaccatctgtgctcaaagcctagtgtcaccacacagccattgtgggacactgggcctcagatttctagcctgaaaaatgggggaacaatgtctgtcatataaagttgctgtaaagatcaaactggataagaaatgtaaaatactcaacagtgcctgacacaaaataaacaccaattaatggtagcaggaagaaaagagcactcttcaccaacattttaccttcagaaattggttaagaagaaatgagtgcttaggaaccttcctgttagagctgggaacacaaataaccccaagatatgacccaactgagaaaagagatacgagagtcagcaggtctcaggactcgagaacatatcatagatctggggccaaggggacctcccaatacctcagtcttgaattagccagatgtgcctttcagtccttggctgagctggactgaggcctcctccaaagggagaaataaatgcgcatcctgaagagagctgactctgaaagagagagaaacccacagaggctgagtttcaccagtacagctactttcaagcacattcctcagttaagtcatttctcttcccaaggggaggactgaatgagcttatggtgagaggccaaaagcttttctcctttgtttttccctcatgggagaggacggaagtgctatcctttctgtgggaacctgcagactatggacgtttcccccagcagttggcattgactgatttatctgcatgtttctctgttcacatcctctatatgaagaatcgaagtgggaatagcccccaagtaatctgatagtaccaaagcactattctagttttgtataatttttaagtctcttctttaaatttttttttgcagactccatcccagacacagcataccagagtctccaaagggctaagctcagcaatctgttctcaagctcccaacaggagtcttatatagtcaggcaggcaatgatcatatatggggaccattagaaataatctaatgcataccctctgaacttcaaatttttagtattctcattttctgctcaagctcaatttcaacacagttcacagtttctcatatccaccatggcattctgccaaggaactacaactcgtgttctctaaacccatctgttctaagaatgctgggctggttatcaatttctaatgtacctgcttaaactttcctctctcaatatgtccctgactgaactgcagaagacagaacaactgtactagccatctctttctgcatatcccatgtccccacagaggccactgtgtcttcataaagctaactgccacgattttcacaagtgatatttttccttcatgattttccattttctacttgggcattaaaataccagggagaaaaggaagataatcgtttagcagctgggaaaataagatatgtgccccagcacagtacatgctaagtattcagaatgtatagttatagtagataactataaattagataactattaaaatagttatattagataagcaatatttttctcatcttcaagacttaaaaagttaactgttttaagtggtattcaaaaaaggaaggtactcactcacatcaaccctattgaaaccacatttctatagctggatgtaacaatcttaatccaaatcattcaccaaagttgtttaactttcttaaagtaaggctctagacatttgcttctttacaagtatcttgcaaagccattatgaggtagaagaaatgtttaaatgcgccacattttcctactgcattgtaactaaaattactactcacaggacgtgtatagcttctgcattttggtccatcacattttccgccatcaaatgagtgtattcttaaggttctcactttatcatcagcataacatattttgcttccagaatgcccagtaaggctgaaatttttcatttaaagtgataaaaaagttccccaaatatctacttaacaatcttagatctgagttttagcaagacagtttaatgcatacacaatgaaaacactatatttctcactctctctcacatgcacagattaaaaccccaaagttttcactatatttcctctttcttatacagctcaatttttaacatgcagcttccttataatctaaaaacaattttaaatatgattatcataaaaatattttaaaacagagatgaaatgtgtaaaggcagatatagatcatccatggttacattggttacatcacatttctttagaaacagaactgtttctactcctgtagacaaacttctctctcacacatttaaagtgaggttagtgctgacataaaattatcgctctactcaccatctgagtgtttgcactgtgtttgaggtacattttcttcattttcacagccccaccactcttgagagtatgagtcaacagaagtttgcaggctaaaaccattcaataatattttcatcaatactggaatgatagtaagtaacattacacaacatcagaggccaaaaatttttctttgttgaagcccaagattttaacttattcttcattacctgaaaatactgctcatttaacctcttcaggaaaaaaaaaattctgtagatgaataattcctgccttaatgcttcacccaagacagttccttcatacttatcctccaatgctttgttcttttcatccatttgatgtagcaggcaacaagaatcacctttcctttggtgatctgacatagcgatctcttatgtttttgctaattgtttgataaatatttagtaaatttttccacgatatgtatgcactattttttgtagttccaattctaaaggttttattaatgaatgaacattgtcatcttaaaagaacaatttctcagtgcttcataaacagctctaaatgctggttgcttatcatcatggtaaacacctctgttcccgtgaaaaataaagattccttcttctgcttcttggcaactgcttccatatagacagtgatctggacgacacttccattgacacggaaagacaaaaaggctttctggattatgaaaaaacaggatatccaacagatcttgatcgcccatgtaatgtttaacttgtatattttaagccatgtcataagtatatctcctcattgtagtcacacagttgtcatattattcttgaaatacttccttctcattcaagtcatgtttgtcaacataactccagagtttactccagcttttccacactatggatgcctagcacagcgactataccatcctatttgacattccttgtgttctggggccattgcagaatttgtgtggaattaaatttctttagtaaagaccaaatattatcagctggtcttttaaaaaggctatcagtgtgagagtcaacttctttcaggaataacggcaaggacaatctctgcaaaccacatggtttaaagagtttttccactctgctgcattctcacttggaaaggttatggagtatattgtataattaaatatttgtagaaatgacccctgtcaagccttcctttaaagctatgatgtagttgatcttcagcaaaaatctggaattgaagaggtttgatcctgaaaataatagctgacttcaacatggtcatagtttcttccagtctttcacctagatacattttctcaacaggctgtattttcagactacacctgtcccacctgcggggatgagcagcgggacaagcgctgctcgcgcctctcaccgcaccgcatccgcctcccgccagccaggaagccactgcggcctgcggcttcccgccaccacggcccgctccttcctccggggacacggggagctggctgaaggcgtaaaggagcgagcagaagcctcaggccagacacagagccaccacgcgcggtagcgccgcatggccccagcggcgttcctcggtctccgtctccgccgcgcccgcctgacgaactggagcacagggaccatagttctggaaatttatcctttttctctccatggattcagcagcagcgtctaaaagaaaaaaaatcatcaatcaatcatttatatatgttttaatataaagatataaaacagtggaaccagtggaactggatagaaagtaattcagttttacagaacacatctgtttttcaggctcttacttttcttaaacataaaagagccatatatatttctatggaattccccttttacttaagaattcattatcagcgaattagtgtaacgaggctgttttgttagaggctgtggttgcattcaaaaattagaataggaacaacgacttgtaaaaattcaacactttattttatttttgagacagtttcactgtgttgtccaggctggagtgcagtggcttgatctcagctcactgcaacctccccctccagggttcaagccattctcctgcctcagcctcccgagtagctgggattacagatttgtgccaccatacctggctaatttttgtatttttagtagagaaggggtttcaccatgttggccaggctggtcttgaactgccaacctcaggcgatcctcccccctcagcctcccaaagtgctgggagtacaggcgtgatttaacattttaacattttaaactaccacttactacattcactgtgtctgtgatttaatatacctttttcagtggccacaaaattataaaatggatacagaatagtctcttcaaaacattaaggaagttctttcttttttctttttctttttctttttttttttttttggtttgagacggagtcttgctctgtcgcccaggctagagtgcagtggcacaatcttggctcactgcaacctccgcctcccgggtttaaggaattctcttcttcagcctcccgagtagctgggattacaggcgcccgccaccacgcccagctaatttttttgtatttttagtagagacgaagtttcaccatcttggccagactggtcttgaattcctgacctcatgatcagcccgcctcggcctcccaaagtgctgggattacaggcgtgagccacagcgccccgccgcaagttctttcttcttgaaaggattataaatataattcatactggcatgacacttttactaatatagattgacttttcgcttcaaataacccattcgtatatcgaaattaattttggtcagtatgtgtgtgtgtggatgtatgtgtgtgtggatgtgtggatgtatgtgtgtgtggatgtgtggatgtaaatggcagtaaagggtaaaagggaaggtggaaaaaagggagatggtctaacattttccacacatttttaaatacacaaaatgtatatttaacacaatacacatacaataaaatatgtagtaaaacaatggtgtggtgaaaacaaaacattgcgaactagaaaaaagacttagccgctggtcctgtcggatccgccccgcggcggcgccctccagccataagctccacgcagttcaacaagggcccctcctacaggctcttggcggacgtccagaacaggcttctgcccaaatatgactcccagaaggaggcagagctccgcagctggatcaagggattcactggcctctccatccgccccgacttccagaagggcctgaaggacgggattattttatgcacactcgtgaacaaactgcagccgggctcagtccccaagatcaacggcttccgtgtagaactggcactagctagaaaacctctccaacttcctcaaggcaatggtcagctacggcatgatcccgtggacctatttgaggccaacgacctgtttgagagtgggaacaatatgcaggtgcgggtgtctcttctcgccctggcagggaaggccaagactaaggggctgcggagcggggtggacatccgtgacaagtactcagagaagcagaacttcgacgacaccaccatgaaggccagccagtgcgtcatccggctgcagattaccaacaaatgtgccagccagtcaggcatgaccgcatatggcacgaggaggcatctctacgaccccaagaaccgcatcctgccccccatggacaattcgaccatcagcctccagatgggtacaaacaagtgcgccagccaggtgggcatgacggctcccgggacccagcggcacatctatgacaccaagttgggaatcgacaagtgtgagaactcctccatgtccctgaagatgggctacacgcaggttgccaatcacagcggccaggtctttggcctaggccggcaaatatacgaacccaagtactagccaggtggcccagtggcccacggggctccctccgccggcaactgcccagggccaggggaggccccttactaccaggaggagaccggctactgaggctcccagcacgctctctccacacatggtctccccgtctgggtgttgggtttttctgtgttttcatcttttttttttttaacctgttcagtgctgccagtcaaccgagggtctgtgagtggcagcgtgggatcaggcagcagggttttttccccacctccccttgctttggttccttggcaggactgagacaccgggctgtgggggaagggatcaaggccgtatcctgatgcgtgtagggtgaaggtccccgctggcacttccaggctgtgggctgagctgtgctggggagaagagacctgggcatggagggaaccagtccccgaaggtttctggttgcctctcctcttcccctttttgtcagccgatcagtttgtggtttctgtacctgcaaaagtttcaggaagtattaacaaaagaaagaaaatttttttcttctccgaggaatggggcggagacagtggagagggtgctgggaaatgagtcccctgggagagggggcccagccatgatgctaaaatatctcaggctcctgagtggctggatttccctaggaccctcagaccgacagacctcagaccctcagacctatgctggggcccggtgaggaaactgagacccgtacaagttagtggaattctgagttgccaggattaagtctgacccctctccatcctagctcccccacccccgtggccctcagtagggttttttgtttgtttttgtttttgttttttttgagatgcagtctcactctgtcgcccaggctgaagcacagtggagtaatctcgcctcactgcacctcagcctcccagcttaagcgattctcctgcctcagcctccagagtagctgagactacaggcgcccaccaccacgcctacctaattttttgtatttttagtagagacgggatttcaccatgttggccaggctggtcgggaactctttccctcatgtgatccgcctgtttcgtcctcccaaagtgttgggatgacaggcgagagccaccgcgcccaggccctcagtaggtcttaaggagccccggccctccttctccccttccgggcctgaccaggtctactgctctatctctcccggctccaggccacgccaagtactgcacagagccctccacccaggcgccctgcgctatgagataatgtgaaataccgactgtggaccaaacgcaataaaacctctgttttttaagaagaaaatgaaaagacttaaaactggcattttaagactttattatgtattattaattatatattaaatataaatgttatacactttagcgcctctatctcccagtctctggttaggagcttaactttcctaagcctcaattagtaaacacttatggcctagccacgttgacccgcctctctcctaacatcatccagtacatttcggaagcgcatgcaaaactctcccaccttctgtttcaacagatatgtcaactgatacaattatacaataattgtataagataatattagatttaatctcacaatcacactcagcttgattactaacccttctcttacatcttgctcacctaaatttatctacattttctgtgaactgaaatagcttagaaatgtatgccatctgtgtattatagtgtaagttattgtaatatagaaatatggactttctttaactcccatttgctgcctaggaaataccaatattttttgagcatggcaagtgtttccaagcattcagaagtggagagtgtaggaaatccactgcagaatgaggtctgcttgtcatcctctcagtctcaactgctctccctccttcatctctctctgtttcattgatgagtatagaagatcaggcatttttatatgaagtgaaaattgatggaactaaggtgttgatttgaatatccaaccgaccatttactgagtgtccattacaagttaaattgtgttgtagagaacagctcaggaaacgaatgcttgacattgatgtacataacaaaaatacaaacataccattaaaaaatcagacctcttatgacaatccagattctcatgtaagttttgtgaagctctttcaagatgagaatgtaaaatttcaaaaaaaaaatcattttaacaagtcattcttgagatagaaaagtggaattagaagatcatatatggttgtttcactagctcaaatcttatgtacagtttttagtcaattgacagccatatgattcttattttatatgctgttattcattagaaactacaaattttaaaaaatattcctgtctcattctatgaatcaatctaaaaatttcattcatttggttatatttcttcattttacctggccttgaatacttctttcccgcccagcattaaatttaattaatgtctaatttgtttacttggtttagttacttttggccatgttcagtacacttcttatgaagcaggcatgtaggaatgttgacaagtttatggtcctcacttttccaaatcccaaatggtggcaccccaacagacacataccacagtgtaaacacatacacacacacacaatccacacccacccatactcacccacctacacacagacacacacacacacacacactccagtggatcaacacataaaacactccacaggcaaagacattatccatcagggatctcttagtgcactacacacttctgtaaattatcaggactcctcaattgaggtgagtctacagagatttcaaaggctatttgagtgctaagctatctaactagtggttggacactatttaaataatgtgttaaacacaactcttgaggctctgaagaatttctatgctttccaatgaaccaggagttacaaggtcctgaaaaccacaagtgtgttacatcctttaatagataaagcaaagctgatattaatgtgaatatactttatatttacttatattcgtgttaatttttctttgcctgtaatacatatttttatataatggggaataagaaacatcttaggaaaaagaaaacaaaaaataaaatttcactgtttacactgtgccttggtccagtaaccctgcactgcacatatacactttaaattggtgtcttggggaaccacctcggtatttcattttaatagcgcatcctggagaatatatttgagtggatcacatattacaactgatttaaattttgacccatatagaaatgttttcaaaaatatgtctgaagcctggatactgtaaaaatgtttatcatcatagaataataaaaggctagccattagttactcagaaattgttcagtaaatctaagatgacttagacataaatagttatgagtgaatatagttcatcattaatgtttgtaaaaattaatgctgtcttttatggttgagaaaaactagaaatgtaacttaatttgatagagataaatgacataaactttacataaagcaagagaataatagatgtgtaaaaatgttttgtagataagattttaagatgaaattgtgctgaacgacatgaatcaaatgtgttttgcatactacatctgcagctacaacatcacagccttttaagtatttcgttaacttcaaaatgtaacttattgctgaaacaatctgatttaatgaattgggataacgggtaatgattggtgtcagctgaaagcaatgctacaattttaaagttagatttctttgtgtattaatacaaacaccagagaagatggtcaataaagtaattactgtacaatgcctatcataatacttaaacctggaagaaaatcagaaaatgttaagtgaatagaattggtgaattgtttccattttatacaattttttgttcattttagggcttaccaaaacttgcagctctgaataaggcccaattatttactccttcaaataaaacaagactgcaagaataagagtgaatgctttgttttgttttgtttttcactgaaatattccagtctgtagcagctccaaatcacactgatctttctagagtctgatacaggtcctggtctcaaggccagtgttaccataatcaccatcttttgtgcttcaaggttgagccctcctaatttacctgcatgaaattggaaaagtcctgtttcatactttaagcaacctagatgtctctttcactaaaagtggtattcttcttgtgtgttttttttttttttttttgcagcaaatgatgtcaacttctacctacacctgacatctcaattaatttttgacattttcttcttcacatttccatttcaaatcaccaagtattgtcagattttaccttctctctatttcttgaatgaatttttctctttctatcttcattgccatcatggattccagcccatcactctctcacctgggctatggtgcacacctctaaagtgctctccctgattctctctccaaaaatggttctgtgctatatctggaatgattacttgaaatgtaaatacaatttgcattgtaaattgctttgcttaaaaactcccaaagacttcacattagtactaggataaatagcaagagtccaaaaatgggttcaagcagtacaaaatttgtttcctttctctttcccccctcttgtggcatgaacattgttgaactaaatgattcagatgtatttcttcttgtctcctggactttggtcttcttactcatatgcttttcccactaccatcccagatttatataattagctcttactgggtttttttgtttgttttttttgagatggagtcttgctctgttgcccaggctggagtgcagtggtgtgatctcagctcactacaagctccacctcccaggttcatgccattctcctgccttagcctccagagtagctgggactacaggcgcctgccacctcacctggctaattttttttttttttttttgtatttttagtagagacagggtttcacagtgttagccaggatggtctcgatctcctgacctcgtgattcacctgcctcagcctcccaaagtgctgggattacaggtgtaagccaccacacccagccagctcttactcttattttagtttgctcttcatcttccccaccaagggaaaccttacctgatatccctaaatatgaaaggctttcataacagtgcatagcttttctctgttatttataatattgtttttaggtttttatatttttattactatttataatagatacatctgagcatgctctttgataataagtctaataaagttttgatgcatttagtaattcagtacaaaattgttttctataagccatgattctagagattgaggggaaagtgcagtggtaatctgtcccaaatggaaggacaaatagccaagcaatgttgacctacccattcatctctcaaaaacagagttaagatattgattctcctgttttcaggatgaagcagggacagggagtttcttgttatcctctcaactcactctttttatggaaaaagtaattaatctgataaatgacacaaaagattttgatgttcattaacaaggtggtgattccaagaagttgaaataaaaagacttcagagcccgtctctctcaatcactatctttggtctcttgaggatgcttgtgcacaaaatagggagcacccatgtaagagctgcataggcaggctcagtccagcaactggtttcataaatccaacttttccaagcatgatggaatgtcagaatcccgtgagccaaaagttttatgatgagagaggaagaatgatatttactccccaatctaatttttaaattaaattttaaacaaagttaataaagttaacaaacctgaatacacacacacacatgcatatatacccacgcacatgcacacaggcttcttgcattcttttttttgtttaatcattcatgagaaatggttggattttgtattttctatctaccaatacttgcacaaactctggctgcaaaacttttgttggtcaaatattagcatttgggaaaccacatccctgctgagagatagaagatcttgatacaaccttaactacatcatcagtagacatgggactgtttttaaccagaaggaggcaaatgtcttccagatggttgtgtagctggttttaacagtagcctgcagtggctttttgacagacataaaccttactagttattattaggcttcagagcattagtatgaagttttaatttggcttatgttagggatgagaaggtagcactatcctagatgccctaaatattgctccttgtcactttttccccactgaattcagaggtaatctggggactgtgtctaaaatggccttatattcatgtgtttgccatgggtttctgaagctttcattctgaacatggtctcaagttggctcttgagggctaatttcattacacatgatcataggcataaatttaaatttgtggaggattgttttgtacatcccacatgaaggggtgacctgcccctccacacctgtgggtgtttctcattgggtgggatgagagactgagaaaagaaagagacacagagacaaagtatagagaaagaaacatgggcccagggtaccggcactcagcatatggaggatccacgctggcaccagtctctgagttccctcagtatttattgatcattatctctaccatctcagagagggggatgtggcagggcaatagggtaatagtggggagagggtcagcaggaaaacatgtgaacaaatgtctgtgtgccataaacaaggttagaaaaggtgctgtgctttgaggtgcacatacataaacatctcggtgcattaaagggcagtattgcagccagcatgtctcacctccagccttaaggcagttttctccttatctcagttgatggaacatacaatccggttttacaccgagacattccattgcccagggacgagcaggagacagatgccttcctcttatctcaactgcaaagaggccttcctcttttactaatcctcctcagcacagaccctttatgggtgtctggctgggggatggtcaggtctttcccttcccacaaggccatatctcagactatcacttggggagaaaccttggacaatacctggctttcctaggcagaggtccctgcagccttccgtagtgtgtagtgtattgtgtccctgggtacttgagattagagagtggtgatgacttttaacaagcaaactgccttcaagcacttgtttaacaaagcacatcctgcatagccctaaatccattaaaccttgagtcaacacagtgcatgtctctgccagcacagggttgggggtagggttacagattaacagcatctcaaggcagaagaatttttcttagtacagaacaaaatggagtctcttatgtctacttctttctacatagacacagtaacagtctgatctctctttcttttccccacaccacagaatctggattcactaccaagagactgtagcatttatcaaaaagaagataaagagaaataagagttcttgttgtctagggaatatatcatcttctttaggtaatgcttattaatgctcctcaaaatagctagagcattcaagctttgtaccgagttcacaatgagagaagtagcttctactagaaattaaatatgttacttctttcattgagtaactattgctacaagaatacgtttgctgaataaattagcacatttattgatataattgatttgcatactgtggcagcacttcatggaccaaaccctaagtcccatgaaaaattgaatagaattatttgacagttaagtatcattggaaaagcctggctctagttctcaggaagcaatctggttgattatgtgttttcggtgtgtagtcataatacaactgtatatcactagtgtacattagacactttgtgcactctacatatattttctcatttgatccttcaatacatgcataacagaagaaatagacgtggatttaattgctccactagggtcaaagaccaaaaacctcattacaatgccaatgttagaaattcttcttccaattaaaataaagttaccaaagacaattgctcctgccataatgagaaaatatcggatgaactttaaaaaattattttttttttgtttaaagccatcaaaaaattgtgggtctaaagtgtcaatgaactaaatttcagagaaaaacaagcccttccttggtgatcacagattagcagcagagcccatctctgaggacatttgctggatctggggccttgagtaggtagaagaacaagcctacaatgtgcagacagctggaacattgggaataagcaaaataatctacagggaactgcaagagggactgaaaactagaaagatcacgtgttctcctcgcacttacttatttccacttaagagacagggtctcattctgtcacccaggctatggtgcagtggaataatcattgctcactgcagcctcaaactcctccctcaggtgatcctcctgcttcagcctctccagtacatggaactacaggtgcatgacatcatgcttggctaatttttaatttttttgtgtgtggacacaaaaaccgactaggtttcccaggctggtctagaactcttggcctcaagtgttcttcctgccttgacccccaccctctccaaccaagcactgggattacaggtgtaatgacagggagtcatcacatctggcctcccctagcatttagatattaaactgttggaaaaatgagtaaaaaataaatgtaagtagcattttgagtattttcttcccatacacccatggattgtttagtgtatcttactacttcacataggagaccattcctgcatcaaactatataaactaagtatttaaatttgattttttccctacaataagctctatgctaaagctcattacatttgattttgacaatctgtttttataccacagttgcaaaaaattaatcacattctttacttcatgagacattatcattattgtttcctacaagtttctctggttttacttgtttcatttttttattccttatcccttgtcacagacaggcatgctaatgtgtttgatataggttctttactcttaaagaattcttacaagataagaaggttgttttctgagtgtgtgtatgtgtatatacgtgagtgtatacattttgcttaaagagtattgtgctataaatctaattttatttctaattttttcacagagcataacatccttcatacattcccacattgctgtaggttatttttggttgtttattcccctgtagctgctgcatagttttcaataaaatgaatcaaccacattttccctatccagtcttgcagtagaattcacactgatatcctgctactgaaatattcacttccttatggtatccttatgaaaacactttttggtcatgtgttacaatttgtcaggggctatgttagtctctttatattgctatgaagacatacccaatgctgggtaatttatttatttattttttaataaaagaggtttatcttggttcggggttctgcagactgcacaggaagcaatgctatctgctctgggtgaggcctcaagaagcttacaatcatggcagaaggtgaaggggagccagtgtgtcacatggtcagagagggagtaagagagagaagggggcagtcccaggctgtttctaacaatcagatctctatgaactcactgagaagaactcactcaagtggattgtgctaaaccaagcttgtctaacccacagcttgtgggctgaatgcaggtcaggacagctttgaatgtggcccaaatttgtcaactttgttaaaagagagtttgtgtatgtgtgtgtgtgtgtgtgtgtttgtgtgtgtgtgtggttttttttatttttatttatttatgtatttattttagctcatcagctatttttagtgtattttatgtgtggctcaagaaaattcttcttccaatgctgtccagggaagccaaaaggttggacattcctgtgctaagctattcataaggcatccaccccatgatccaatacctctcactgggccccacctccaacattggggatcatattttagcatgagatttggaggggacacacatccaaattatatcagggatatgtacccatcatcgagacaggttgtagagtatgcatactttcaaatgggtcctgtcatgttattttctgaaatggttaaaaccatttaattttccatccattgcccataaagcttgttttcctcatatcctcatcactcaatgttatctaggattcttatattttctaagcaagtggtgaaaatacagatctcattttatttgtgtacatttgcatttgtcagattgttaacaatgtattgaattttttggcccatttttctattgagtttactatcttctttgttcatctgaatatcaatcatattcactttgccctaagcagtgtcaacattttctattactctgtcatacatctgataactttgtatgccaacctttactgaaatgagcctttatgatttttatacttctagagtttatgtatttaattaaatttattggtttagtatatattttattaaactgtaacaacagtcccaaatctatgttttgctgggttcattcagatttagaactcagataactttttggaggataaattctttttatcataatgaagaatggctatcataatgcaatatgattacttctgccaatgcttattgttttatagtctactttgtttctgtggtcaggaggacaagacctgaatggccttgaccaactcagctttctgtacctcctagttctcagaataactttagaatgttccaagaagacaatatcctgagatgagtagaaaccgtctgggacagtctgggctctgtccttgttgttcctaggacaggatattactgcagcccttaaactcagagagccaaggtgcacgtggggtgtgaaacctagggcggagcactcaggggttcctcagcgcagtacacagtggggcatgtgcagaggagactccaccaaccctgggcaacttttctgacctcaagggtcaggcttgccatagaacttaacggttttgctgattcttcctgctcctctgtgagtaataaatttggtttgtctgacttactgtgcgagcattcttctgttcctggcagcttggtttatataaaaaacctcctactagacctatgaatctatgcaatgtggaagtgtcatagaggtaaataagaagcaacttaactgagttgaaaactaacatacataacatggggccactgcaccaaggggcaaaatgatcctgccaaaaagtcccatgtgaccattccagacatactgtggaagaaggatgctgaaactcacagagatctgaagatcttatccaagccaacaggaggctaataaagcaagagaattccactgtactctgatgcgagagtacaagcttcacctcagagaatagcaatgcaatggccccagcgatcagaccagagagaccctctgccacagagaaagcagaggtctagagaacagcatgaagacaataagagacttcagattcactttccctttgccttgaggccacagaaagcccaaagcatctgaacatcttcctggaggcatttaactaaaagagagctattgaaacttgaagaaaaatgtgaatcaagaagctaaatttaaagatatgttactttctccaaccatcccccaccaattaaccataggatgagtctagtgagataaagcatatcatttatacaaaatacaaaagttatatgtcctttatgtgggcagaaatatgttcaagctttactcaataaaggtatcttgttttactactagaaatggtaattttcacttggtcattactttattttataattatctctatttaaattagtatcagctcactcctgggtatccacctagaggaaaagaagtcatatgaaaaagacacatgtatgcacattcatagcagcacaactcacagttgcaaaaatgtgtaacaaggttaaatgtctatcagccaatgagtggacaaagaaaatgtgttatagatacaccatggaatactactcagccctaaaaatgaatcaaataatgacacttgcagcaacctggatggagttagagatgattattgtaagtgaagtaactcaggaataaaaaacaaatattgtatgttctcacttataagtgggagctaagctatgagagagtgaaggcataagaatgatttaatagactttggggactcagagggaaggttaggggggtgagggataaaagactacacattgggtacaatgtacactacttgagtaatgcgtacaccaaaatctcagaaatcaccactaaataacttttccatgtaaccaaaaaccacctgtttcccaaaaactattgcaataaagtaatatatatgaaaacaatcaacatgatagtcttgaagtgcaacattcactgggtttcatatgggagaaaaacagctaaaatcaaacacatggacaggcagtcagaacaatgtccatcatatacatagtaaaattaatacaaggacaaacattcatgagtggagtccatttgaatcagcctgtagtgaagacatgtgccttagggcacacataactcatgttagggagaaaatgtataattttactcaatgtgaaaacatcttcagaaataactcagtccatgctgtccagatgcagttctgttctgtagagatgaagaataagaatcatcaaagtggaaaaacctctgtcctgctccaaattctggtccacacaggagtagtactactggagagaaaagccatacatgtcccaaatgaaggaaagcctttacgttatcagtcatttcttatgagacatatgaaacttcacactggagagaaaccttatgaatgtaacaaaagtgagaaaggctttagatattccctacaccttaataaatatttaagaaagaacattctggagaagccctatggatgtaaggaatgtgggaaagccttcagcaaggctcaaaacatgcacatataaggagtcacactggaagaaaccctataaatgtgataaatgtgaaaaagactttgcaaagtcaccagaattaaaagccatcttaagattcacaatagtgagaagccctgtgagtggcagggaaatcatcattaatttttcaccgtactgaacatgtgaggaggacatactggaagggagctcaatgagttaacatgcatgagaacatctttcctgaactctcctatcttacagaagtgtgaaaagaaaccctctgaaggtaaagtctatggaaagcctttcatcttcattcatcgtgagtagatatttgttctcacactggagagaagctatgaaagtaaggaatatgaaaaaagcctcagtgttgtctcagactcatagttcatacaagaactcacacagcagagactgcttatggaagtaaaaaatgcagaaaatacctctttaaacactatccctcctttatacatgattccacaccctggagggagactacaattgaataaatataagaaagctttcagttccagctcttcacttattgggcatgaatgagcacagggtaggactgaagcacagtaaacgttaacaattattgactttatcattgtcttatccctcaattagaactcaaattcataattttgtagtttttcctttcttaaaaaatggtacaagatgacagatatctgtcttagcaacctttccgctctgccaccttaatgttgctatgtagtagctttgttacaattcatttacatacacatggtttcattttcagtgggaagcccttctgagctccattcaatttagatttagaattcgtatgctccatgataccttttttgtcagtttgttttttgttggtcacaatttgactgcattatggtcacattatgtggttttaatggtactgatttggggtacctgttatgactttcattttggtctaatgtggccaatgctgtccatttccctgctatatccattattctcatcttcttcactaagggaacatagattcactttttccaaggagcactgtttaaatgtctttatttatttatttatttatgcatattttattattttataacttttttttttgaaaaatggtctcactctgtctcccaggctggagtacagtggcatgatcagagctcactgcagtcttgaactcctgggctcatgtgatctcccagctcagactcctgagtaggtaggactgcaggcataacaggtgtgcactgccacacccagcttttgttttgttttgtttttgtagagactgggtctcgttatgttgcctggactggtttcaaattcctgtgctcaagtgattctcccaccttggcctcccaaattgctggaattacaggcatgagccaccatgcctggccctggttaacgtctttaaatgagtttcccagtttttctcgtaactgtagtgagcgaatcttatagtcctggccaatgtgaaatgcagaattcactgctttggatttctgaaaatctgtttggaaaggggagagttattgttcctcttttttgttgaccaatttccctttgctttctctgcttgctgctctctggaaataggatgaaatgccctgagttgggtttagcaacttgaagaccattggaaagattgtccctacaacaaaaccttcaatctacaagatttctccctccccaatggcatgttgtgtatccctggctgccgtggactatttctggacttgtttcatgaaactaacccctagtagaactaagaaacattttaggagagaagtttacaacagattaaatgataaacctaaaaaatgaataaaacatattataaaaataaagaggatagacaaaacgggcttgcagatgctgactggccacactcatccttggcgcttgcccccatggatgcctcactgactgacacttggagagctggcagccatcactcaaaaatcagaacacagtggcctctactgcagcatcagggaaccaaaactaagcttgtcagctctcaagaaacatacttatgtgtgtgtgtgtgtgtatatatatatatatatatgacataaatttattcagggactttgaggtatctcatgctaaacagataaaatgaattaaaactagtgcaaagttatggcaacagtactccccattatttatgcagggcgttgaaaactggcacacgtcacagatccttaagtcattctctgaatcaggaggagaaaagagaacagagagagctcactgtatgtgccagtcactggactgagtactgcgcctacgggatcccacttgatgcttgcaataaccctgcaagataaaggtaaaaactcacacacacacacacacacacaaactcacacacacactctcacgcatacatacacacacataaactcacacatacacacgcatcctcaagcacacactagaaactacagaacaaaaaagcattgacaactaatagaagtatactgctggccaaagtggctcatgcctataatctcggcactttaggccaggaattcaagacaagcctgggcaacatagcaagacaccatctacacaaaacattttcttaaataaacatcatttttaaaaagaggtataatgcctacaggctcagggaagcaatacccctatggctgtatggtaagcagcaggcaaggctatttttcagaccaaagtggtagtgactccagggttcctttgcacacttagccaggagattggctagctcagcactgcctgggttcactttacccttctacagttctaaagctctggcaggtgggacctaagcatcacagaaagtgctattatgcaggactctcttgactgcaagtgactgaaacctaactggatccagcagaacattgaattatttggctttacttactaaaaatgtacatgagtagatgggcttctgtctcagtgggatcaggggtcaactaatatcaaccaaggctcattctgtcccttcatttcctgtgtcagctctgcttttcaggcaagctgttttgagagagcagcaaaaatggccccataaagttcacatcacttacttccttacaaatagatatgccaataaaaagaaagcacctcattcccagcagtttcatcagaagttcagggatgacttccatgagcccagcttggatcacatgaccactcctgaatcaattaccctgctgatctgattgcccagggtgggtcagccttcccaaatcacatggactagtattgaaagacaggtcctcccatgaaaagaaaaaaaaaaaaaaaaaggaagggtagtggcagaggaatatgagtggggggggcctcatctctatataaaaagtatgagcgtatttgtgctcttttgtacattcatttgtatagtcactgggaaaaaaatgagaaaaacccaaacacggctttctatatgcctctgtgctttgttttcaacactgagctgtgagaaatctagttactaaaatgaaactgtgaaaaaatataacaatttgggacaatggggacacttagctgatgcagcacaggtgaacagttcttcttttgtgcccaagaggacacaattcccaggaggctgcatgtggtctcctaggacaagcctgtgggcacccactggctgcagttccacctttccttccctggactctcaggaagacatgagttctggattcagctgaactgagctcaagttcaagttctgtgactcactggctctgtaattctgggtaagtctcttgctctccttgagtctcatatcctccttggtaaaatggagaggtagagctattgttagattttgaaggcaaggcaagggttaaagaaagacagagaaagacagttgacggcttcaacagcaacacctttattactagcaaaaccctgcagaggaggaaaccagcttactgccagcaccaactgcctctcacaggctggggtgatcatgggactgggaaggaggggtgtgggcggtagagcttgctgcccggcaggatatggcaaggatgttcctgcagtcaggctgttgggcctttgcccgggagggtgcgataaggatgtttctacagtcaggtgatcaggaaggatgcttctcacggcccgagttcccaaggaatgtttcattctgaccagggtgtgcaaaacggctgcaggtttacaaaatggtacaggttagactaacagcaacatctcccaggtagacagttctataaagtaaacttcccttgagcacctacactgtaccagacatggtgctaggacccaggccacaggaggaacaggacagatgaggcccctgccatcctggtgctcatgcctgatgaaggaagctaacaggtcgtaagaccaggtcacgtggtggtggtaatgaaagacattaccagccacttcgaggtccctgccagaacctgactgccacattccccaaagggaccagactcctcggcacactagctgaggtttctataggcacagagaaaacactgtcccaactgttgcaatggagctgggaaaaataatgttttttctcaatgcttagacttaccaattgcttcattttatcacatgaaggctgtgtggcactttgaagtagaattagtaatttacataattacaaatcatgtttttttctttttttttagatggagtcttgctctctcgcccaggctggagtgcagtcgcgccatctcggctcactgcaagttccacctcccgggttcatgccagtctcctgcctcagcctcccaagtagctgggactataggcgccaatcatcatgcccagctaattttttgtgtttttattagagacggggtttcaccaagttagccaggatggtctggatctcctgacctcgtgatctgcccgcctcggcctcccaaagtgctgggattacaggcataagccactgcgcctggctacaaattatgttcttaaaagaagctgctcagtgccatgcctaacacaagatggaactccacgatgagatatgtgtgaagacagggtgccatggttacaaacaaggactccaggtgcagactgtttggttcaaacctggaccagcggtatgaatttttgcaactctctgtattgctctttgcctcagttttttcatataacaactagaagtaaaaacaaggttattgtgaaaattaaatgaattaaagtaagtggagtgcctacaacacccccaggcacacggtcagcactgagcatgtttttcattactactcttaatgaggtaagaatgagaaaacaggcgccagccatgagcctggggtttatctggcaaaggcatcagagaccccacttttaacatcctccattcattcatttgaccctgataaggaaggagtctcatgggagaggagcaagcctccacctgggggccagacatctcatgatcaaagttgaactctaccactgttcagctgggtgactttgggcaagtgactttccctctctgatcctcatgttcctttttgataaaaacagcaaaatgtcaggcctatggggattcaaggagccaaaagaaaaatgtgtgtcttagtctgaatttcctggaagtagatcctgaggcaaagattcaaatacaaaaattttgtttggagataacgctaggatattaattcgactgccagttcttccttagggtgctaatcccaggaaacatcagtggaggagtggggaactgagacaggaaaggaatgcagcagttaaagggaccttcatcaagaaagtttccactgtggcagccaggactcagccctgccaggtacctctgagagacagcacagaacatgtgcttcagagtcatcatacccagagcaagggaccaggggtatttatccaccaatacccaccagtcactcctcagggatcctcccaagggcatgattcctccagaatgtcctgcctgcgctgcaagggtcagacctggggttgagggcaggacccctgacagcgcttccagcaatgggcagaaccacagcctgatgtgtacagtttcagtcacccagtaactccaacacacacacacacacacacattcacacaccacactccaacaccaacaaagtatatacgtacatacacatacatgcatacatgactgttacccacttagatcctagtgactccatgggatagacgataaggtgggaatcagaggaaagagtaaaattaaggcgagtgaaagtcttaagaacaaaatgcaaatttaggctgaaaatgaagggggaggaggtgtggtctcgacaccaaatgcctgctgggtggcacatgctctacacacactgtcactaattctccaagcagcctcgtggagtaaaagaaattcctctcaatgtacagatgacagaaacatagttcagaaaagaaaactgattttactaatgtctcagcaagttagtgggtgacatggagtcccagatctttctgtccacaaagcctacaaattctcccttgttaggcaggctgggtaccaggccctgcttctgggctctgcttcttttccttctaggctaaaacagcagaactgacagagacatcatcccccttctccacctggagcagagccaatgagaggggctggggaacagccatgaggcccagcacccaccattcaatgtcttcagaattgccgtccctcagaactcttgcaccacgaggtggcagcactcccagtgtctgggtgtcttctgaggggtaccaggatccagtagaggccactggctgtgctgtcatatcctaagtggcagcaaggcaggcttgggtctcttggctgcttcagcaccagaggttggacagtgcccatgcattgagtccctcaggagaatgggagggaaaggaagggcagaatggagtgatgtagggtccatccaccatgtccctggatggagagacccctgctcccacagtagtccacaccaggaccacgattggcactcatgaagatgccagcctccatgtatatgtccttgtctgacaactcctccttattttcatcctggagacaagaaccctgaacacagtagctctgagggcacctgagtgtaacctgagacagtccctgaagacctttcatccaagcaggatccctcccttgccatctgcagacctgccccacaaactccctccctggtctcctggctcttgttcactccttccaggcagccttccacagtcatctctaaaatatatatgactgtcccttcctttatccagcaccttccatggctccccagagccctccaggtcaagttcaagttctttgatcagacactagatctcaagctgcattctacctcctgaattaagatcccggagaagcccaccttgctcagcacaaacgcatcactgaagtcgaaaatcttgaacgtggccttggcattgaggaagtcatcaacaccctggctagtgagggtgcagtgccgctccaggatgatggtgtctaaagttgtgcaccaggtcgcaggccctgcagaagcatctcccctcaggagtgaggtagtacaggaagtctgtgcacaggcagatctgctggtgctgttacactatgagggcactgagctccaagatggtggcaatatattcactgggattcctgcacggtgaggttggagagaggaagcatctccataacacatatgaaaccctggaagcacttcccagccagaaattcaggaccacgttatatgcagatatgggtgccctctgagcacacttgtctctgtctcccactctgagctgcctcctggccccacatgccccagcctggcccagggcttagcccagtgggtgttcagtccatggtgttgactgctccctgggccaggagagcccttggtggctctgtgactcctcctgtggaacccctacctctgccttgggacctcccaattcccatggaagcccccacagctctggattgccccacctgccctgtgatcctccagccccataggccttactcgatgccttagccctcccagaacatgacacgtttctctgaatgtggctgatgtccagggccatctgtagatgtttgctggggacctcttgctgttttcctttatggtctgtaggccagggccaagaggagaaaccagcctaatctcagaatggacaaaaggctcactgccctaacagcaaccaccaaacagtcagcagtgcttctggatggaaaagaggtttcattctgcagaaagctccttgtttggcttctttctgaagccaggaaggggtaccaaacccagcttacctgcggtgcctacgttagcatctgtgcctaggatgcatgatgggctcccactgcagggttgacattccctccagctggagacctgggctcctgacaccacctggcgtgtttgtcctgctctggatgacggtggaaaggctgtatctggtattttcctaggtccttggttttcaccttctagacatccagcaggagtgaccatacccagccccacacctgaaatgggactcccttgtagagcacctgagacctctacagacagaagagtgctctggtgagacaggccacagaggtccccgggggggggggggatcaggggctggaggattctggaggtttccagccttgggctctgtggttcctcaaagagtttaggtttacctaggactaggcctcccctcccatgattcaaagagtgggtgagtgctatgcatcacgaactctgatctggacctattttttcatttaggtcaccaagagacaacccctaacccccaagctagggatggtccaagctctggcatgagattctcttccagcaatgtgatgcttgcagggacagggagaaaagccggtgaccaggcctgctgtcccccaggtaaggacagtgtgctacccaccctctgagaggcaggtggtgccaggtcactgcactgggtccctgtacccctggctctgcagacaccagtcatggaggtcctcccctctccacattaccttcttgctactcccagatttcttctggtcattaagcactttgagccatttttctgtgcagccgatctgatatttttgctatcagatgaaacatgacaaagtaagccgagccaccaggattcctggagggaaccttggatgctgcgtcttgggatccagagccctgatgggactgaaccagaaggagccagggaaggacaaacactggggctcaggccctatgacccaacggccattggtggcctgtcctcatggccccaagacaccctgtcctcaggccacagacaccatgggctttggtcaggtcccagcctcccagtagtgccctggcactggtgggtgctgacccccaaaccacaatagcagttctgggttatgggtttggtaaaaccacctcagggagaattctggggttgggtttggcaggaaccacggggcctcccaggaatgatgtgtcactcctacttgccacaaaatgtgcacagaggctatcccactgaccagcccatcctgctggacaggatggaggaaatcagggaaaaggcagggtggacatctggggtgcagggagaggcaggtgcatgctgggaggtcagaccctgcgagggctgtgggggcatcaggtggggtgggctccaggtgcaccctcaatgcactgggtgggtctcaggccaggctccctggaccctggttggctgatgtggtcactccctgggggactgctgtcaagccctggccacccaccctgggcagcaccgtcccatcccaagaccggattttctgagtcctgagacaggacagtgctgtccaggcctgacagactgggaggacctgccaagtcctccatccctagaccagcctcccacacagcagggacagtctcttccatttaccttcagggcactgactgatccatgtcactctaaggcaaccaaggcagagctgaggacctgtgccaggctgggagccagtcccctccctaaatgggcctgaggaaagcaccatccctgtcccaatgcgccccaagttttagcccaggagacacatagggaagggaggacggagcctctctgctggctgacacttgaaaagcgggacctgggagtagagggagcgcagggctggcagggatgctccaggcccatggagagcttgggctgcaccaaggggctgcccctcctgggctggaggctgtgccctctgcaggatctgagaaagtccagtcctgagatgggacagtgctgccaagggtgggtggctaggcctgacagcagtcccccagggagtgaccacatcacccgaccagggtccagagagcctggaccgagacctgcccagtgcacactgagagtgcacctggagcccaccccacctgacgcccccacagccctcacagggtccgacctcccagcatgcacctgcctctccctgcacccctactgcccaccctgcctgttccctggcttcctccatcctgtgcagcccatagactgttaccatctctctagccactctggcccttcctttacctttgttctttcagaatctctgagcaagatctcccaggtccatccaaacacctgctttgtccacttttgactgggccattggacaccactgggccatcccagctgtccatagggcccctgataacatgcatttcccctgacacctcccagcagtgctcagcagccccactgaccaggtccctgctgaccagatcccgcacatcaggtcctccctgaccacactctcactgattaggcccccatcaccaggccccactaactagattcccgctgccaggcccacagtgtccaggaccccactgacaaggacctcactgacaaggcctcactgaccagggcctcactgacaagacctccctgaccacattccaccaatcatgaccccattgcctggccccacagatgaagccccactgaccaggtctccagggaacaggctgccagtgaccaggtccctactaaccaggcctgaggtgaccagatgccccgaccaggaacctagtgactaggcaccactgaacaggcatgtaccgctcagacccccgttgaccaggtcaccccatagaccagtgctacaaaagccaccactgatcaagtcctctctgaccaggcccccactgattaggttccactgacctgaccaggctgccatgaccagggtcccactgacaagggtctcactgatgaggacatgccctgctgactaggtgccatgtgaccaggcctccactgaatagcaccccttgaccgggtcaccagtgacccagcccattctgacaaggctaccactaagccacagctgaccaggtctccactcaccaagccctgcagcccaggtttgcactgaccagacaccaaacatttgtctgccactaggtccccactcaccaagacctgcactactcgatccctctaatgagaccctctctaagcagaccctggctgaccattcccccagtaaataggcctcactgaccaagtcccaactgactagttcactgaccaggcccacactgaccaggcccttcctaatcataccagaaggccaagtggcaatgagatgtttcatatggcaggggtaggagcaagacagagagaggaaagaggtaccacaccctgttagacaaccagatcacatgaggtctcactatcaggagatcagcatcaagaagatcctgcacccacaccaccgcccactgtttccaggcagaagcctcctgcagaggccaagcctcttgagaaacttccactatggcagtgcagaaggaaaatatgggcttggagcccccaaaaaggaggccaccatcctccagatcccggattcataggcccaccaacagctcacaccctcagtatggaaaagctacaggcactcaacaccagcccagcccatgagagcagccatggggctaaagcctgcaaagccacaggtgcactgccctagtagaggttttccatgagcctctgcctctgcagaaggctactcccccttcctactaccccccatcctcctaccaccctactgacaacctactcctccccaccctacccctccttttcctaccaccccgaaccccctcccattcaagattaaatcgcctaccaccaggccccaaaattaaggattacaattccatatgagttttatatggacacacagtcaatccatattatttgacccagataccccagaacctcatgtccttctcacacagcaaaacacagtcatgcatgttcaaaagtttccaaaattcttaactcattccaaatataaaaaattcaaagtctcatctgagacaaggctacagtcccttcggcctatcagtccctgagttcaaaaggcatttcttttctttcaagatacaatgatagtacaagcattaagtaaggtttctcaatccaaagggaagaaattccccagaaaaatgacaaaaatgtcagtccaaaccccagcaggacaatattcactcaatctttaagctccataatcatcaagagaactcactatcacgcagacagtattaaggagatagtgtttcaccagttgtgaagaatccgtcccccctcatttttcacccccacccacaaaataatctctcctattctccccactcccccacctccaacccccactcttctccatgattaaatcatctcccaccaggccccacctttaacattccccattacaatttcacgagagtattggtagtgacacagggccaaatcatattattctcacccaggtccccccacatctcatatcgttgtcacactgcaaaatacaatgatgccttctctacagtcccccaaagtcttaactcattccagcatttactgaaatgtccaaagcccagtctcatctgagacaacgctgccatcccttctgctcgagcctctgaaatacaaagcaagttaactacttccaaggtacaatgattgtagagacattgggtaagcattcccagccaaaaggaagaaatttgtcagagggaagcacaaaacacagatgggacttgcagaccccatgcaagtcaaaaacccagcaggaaagtcattccatcctacagctccaaatcatctttcctgaaaggatctacatcccacatctagagcacaagagtggatggcggggctcccaaggccttgggcagctcagcttctgtggctgtgcagggtctttccccacagctgccctcgtgggctgggctggtggtcagtgcctgtggctttcccacactgagggtgcaagcagttggtgggtctatgaatctggggtctggaaaatggttcctccctgtatgggggcatcaaccctgtatgttccttctgcactgccctagtaaaggtttcccatgaggctctgcctcttggaaaagcttctgcccagctggacactgaggtttttccttacatactcttgagtctagacaaaggctcccaagcctgtgcacctgctggcttaacactatgtggaagccaccaaggcttgcagcttgcaccctctgaagcagtgacccaagctgtacctgtgcatctttcagccatggctggagctggagctggagctgcagggatgcaggcggcactgtcctgaggatggacacagcagcgcgaccatgggactgacccaggaaaccattctttggtcctagaactcagggcctttgacagcaagctctgctgcaaaggtctctgaaatgccttcaaggcctttttaacattgtcttagctattagcactgggctccattttatgcacatttctgaagccttcttgaattttcccactaaaaatcagcttttctttttgacctcttgggcaggctgcaaatcaaacttcaaagctctgcttctcatttaaatataagtttcaacttgaggtcatttatttggtcacacagaacaccacaggctgttcaatacagacaagatacctcttgagctttgctgcctagaagttcatttcaccagatataccctaaatcatcaccctcaagttcaaagtttcacaggtcaccagggcaggggcaccatccagccaagttctttgctaaggcaaaagaaaagttaccttggcttctgctcccagtaagttgttcattttcatctgagaccttctaagcctggccttcactatccatccttcagtcacccttttaattataactatttaacacatctctacaatagtcaaaactttcattcatctttctgtcttcttccaagccctccaaactgtgcagcctgcggtcgttacccagcttctgaacctgcttctgaacttgcgtctacactttcagctatcgttgtgacagcctggcagtgtggtaaaagaaaaaaagtccattttcagggggaaaattcaagaaggcttcagatatttgcatataaaagaagccaaatgttaatagtaaaaaatcaggaaaaaaaccttgagggcatttcatagctccactctacagtacaaattttctgtagtattattttaaaaagaggtttaattggctcacggttctgcaggctgtaaagggaacatagtggcttctgcttctgggaggactcaggaagtctcctaccataccagaaggccaagcgacaatgagatgttccatatggcaggtgtaggaggaagacagagagaggaaagaggtgccacacttgttatacaaccagatctcatgagaactcagtatcaggagatcagcatcaagaagattaaccattggtgaaggatccacccacaccaccccccactgtttccacgtagaagcctcctgcagaggcagagcctcttggagaacctctaccagggcagtgcagaaggaaaatgtaggcttggagcccacatacaggaggccaccatcctccagactgcagattcatagacccaccaacagcttgcactctcagagcagaaaagctacaggcactccacacgagcccagcccatgacagcagccatgggggctacaccctgcaaagccacaggtgccctgccctagtagagactttccatgagcctctgcttctgaagcaggttactcccccctcctagtacccaccaccctactaacaacctactcctcaccctacccacccctttccttccatccccggtccccctcccatccatgattaaatcacctccagccaggtcccacctccaacattaaggattacaattcacatgagttttggtaaagaaacacagccaaatcatattattctgacctgataccctgcagtctcttgtccttctcacagagcaaaatatattcatgtcttttcaaaattttccaaaagtcttaactcattccaacaataactcaaatgtaaaaaattcaacatctcatctgagacaagtctacagtaccttttgcctatgagtccctgaatttaaaaggatgttctttctttcaaggtacaataatggtacaggcattgggtaagctttttcaatccaaagggcagaaatttcccaggaaaataacacaaatgggaccacaggcccaatgcaagtccaaaacccaggaggccagtatccatttaatcttacagttctaaaatcatgaaaagaactcaccgtcacaaggacagcaataaggagatagtgtttaatgatttgtgaaggatctgaccccccaccccaattttcacccctcacccccaccataattcccccattttccctacacccccatcttccaacccccactctgcaccatgattaaatcatcttccaccaggccccacctttaacattccaattacaattccacatgagttttggtagggacacagagctgaattttattattctttccctcactccccaaatctcatgtccttctcacattgcaaaatacaatgatgccttccctaaagtcccataaaatcttatatcattccagcatttatacaaatgtccaaagcctaaagtctcatctgacacaaggctacagtcccttaggcccatgagcctctgaaatataaagcaagttaactacttccaaggtacaatgcttgtacaggcattgggtaagcattcccagccaaaaggaagaattttgccagaaaaaaaaacaaaacacagataggacttactggccccatgaaactccaaacccagaaggccagtcattcaatcctacagctccaaaatcaccctttttgaaaccctgtcccacatccaggacacaggggtgtgagggctgggctcccaaggcctcgggcagcttggcacctgtggctttgcagggtatatgccccaagggtgccctcatgggctgggctggtgatgagtgcctgtgacttttccacattgaggaaacaagttttgggggggggggtctatgaatctggggtctgcatgatggtggtctccagtgtgggagttccaaccccatattttccttctgcactgccctagtagaagtttgatataaggctctgcctttttgggatgttttgcctggacacccaggaatttccatacatcttccaaaatctatagagaggctcccaagcctctagtctcacactccgtccaccagtggcttaacactatgaggatgttaccaaggtttctagcctgcatcctctgaagcagtgacctgagctgtacctgtgcatctttcagccatggctggagcttgagctgcagggatgcaggcagcagtgttctgaggctgcacatagaggaggctcatggaactggccaaggaaaccatgcttctctcctaggccccagggcccacaatagcaagggctgctgcaaaggtctctgaaatgccttcaaggcctttttccctattatcttgtctattagcaccgggctccttttcatgcaagtttctgaagccttcctcaattttccccctgaaaatcagcttttctttttgaccacttggccaggctccaaattttcctaaatttgagttctgagagacgggactcatttaatgtaagtcccatccagaggttatttcctccatcacacataagagcacaggctgttccatggggacaggacacctcttgagatttgctgcccagttcattccaccagatactcagtaagtcatcaccctcaagttcagtttcacagatctccagggcagggtcaccgtgcagccacattctttgttaaggcaaaacaaaagtcactttggcttctgttcccagtaagttcctcattttcatttgagaccttctaagtctggctttcactcaccattttcctgtgagccttctggtcacaagtatgtaacaattctttacaaagatccaaactttccctcaacttcttgtctgcaaagccctccaaactctctgaactctgtctgctacccccttctgaacctgcttctacattatcagctatctttgctgcagcctgacaatgtagtaagggaagacaagtccattttcagggggaaaattcaagaagggttcagagacttgaatgaaaagaagctgagtgctcactaccaagacaatagggaaaaggccttgaagacatttaatagacccactttgcagtactaattttctctatgatcataaagaagaggtttacttggctcatgattctgcaggctataaggaagtatagtggcttctacatctaagaggaatcaggaagcctcccagtcataccagaatgtcaaggggcaatgagatgattcatgtggcaggaggaggagcaagacagggagaggagagaggtcccacaccctattatacaaccagatctcatgagaactcactatcacaaggtcagcatcacaaagatggtgcttaaccactggtgaaggattcgccccctacccccaactcccactatttccaggcagaagcctgaggcagaggcagagcctcttggaaaactctactagggaagtgcggaagggaaatatgagcttggagcacccacacagatggccaccaacctccagaccccagattcatagacccaccaacagctcacaccttgtgtggaaaagctacaggcactcaacaccagcccagcccatgagagctgcggcaggggctaaaccctgcaaagccacaggtgcattgccctagtagagggtttcccatgagcctctgcctctgcagcaggctgctcccccttcctcccacccaccaccctcccaccaccctactgccagcctactcctccccaccctaaccaacccttttccttccaccccaaccccttccagtccatgattaaatcatctcccccaggccccaacttcaacatttggaattaaaattccacatgaattttcatagggacacacagccaaaccatattattctgaccctgctatcccagaatctcatgtccttatcacagagtaaaatacaatcatgccttttcaaaagttccaacagccttaactcattccaaatgtaaaaagttcaaagtctcacctgagacaaggctactgtcccttctgcatatgagtccctgaatttaaaagggatttcttttctttcaaggtacaatgatggtacaggcattgtgtaagctttctcaatccaaagggaagaaatttcccataaaaataacacaaatgggaccacaggcctaatggaagtccaaaacccagcaggacagtattcactcaatctttaagctccataatcatcaagagaactcactatcatgcagacagcattaaggagatagtgattaaccatttgtgaagaatccacccccctatcctcatctttcacccccacccacaaaataatctcccccattctccccaaacccctacttccaacccccactcttctccatgattaagtcaccttccaccaggctccaactttaacattccccattacgattccacatgagtattggtagggacacagaaccaaatcatattattctggcctttggtccccaaatcttgtatccttgtcacactgcaaaatacaatgatgacttctctactgtcccccaatgacttaactcattccagcatttactgaaaagtccaaggacttacagaccccatgaagtcaaaaacccagcaggccagtcattgaatcctgcagctccaaatcatcttttctgaatctacatctcacatctagagcacaggcatgtgatggctgggctcccaaggccttgggcaactctgcacctgtggatttgcatgatatatcccccacagctgccctcatgggctgggctgtgttgagtgcctgtggcttttccacactaagggtgccagctgttggtgcatctatgaatctaaggtctggagaatggtgtctccatatttagggactccaaccccattttctccttctgtactgccctggtaaaggtgtgccatgaggctctgcctcttggaaaagcttctgcctgaacacccaggtttttccgtacatactctggagtctagacacaggcccccaagcctctagttttgtgctctgtgcagccgctggcttaacactatgtggaagacaccaaggcttggaacttgcacccctgaagcagggatgcaaactctacctgtgcatctttcagccatgactggagttggaaatggagctgcagggatgccggcagcagtgtcctgaggctgcacatagagggggctcatggaactggcccaggaaacgatgcttctctcctaggccccagggcctgtgacagcaagggctgctgcaaaggtctctgaaatgccttcaaggtcttttccttattgtcttggctattagcaccgggctccttttcgtgcaaattcctgaagccttcttgaattttcccactgaaaatcggcttttctttctgaccacttggcaaggctgcaagttttccagacttttgagttctgtttctcatttaatataagagttgtgactcatttaatgtaagacccatccagaggtcatttcctcagtcacacaaaagggcaagggctgtttcatgcagacaggacacctcttgagctttgctgcccagaagttcattccaccagatactcactaagtcatcaccctcaagttcaaagtttcacatatctccagggcagggtcaatgtgcagccacattctttgctacagcaaaacaaaactaaccttggctcctattcccagtaagttcctcatcttcatctgagaccttctaagtctgatctttactgtctattttcctgtgagccttctgatcacaagtatttaacaattctttacaaagatccaaatttcccctcaatttcttgtcttggaagccctccaaactctcctgaactcagtctgctacccccttctgaacctgttcctgcattatcacctatctttgtcaaagcctggcaatgtggtatggaagacaagtccattttcagggggaaaattcaaggaggattcagagacttgaatgaaaagaagctgagtactgatagccaagacatgggggaaaaggccttgaagacacctaatagatcttctttgcattaaaaatgctctcaatgatcaaaaagaaaagaagtttaattgttaatgattctgcaggatgtaaggaggcatactagtttctgcatctcagaggactcaggaagcctcccaatcacaccagaatgtcaaggggcaatgagatgtctcatatgccaggagcaggagcaagcatgagagaggaaaaaggtgtcatgccctattatacaaccagatctcatgaaaactcactatcatgaagacagcatcaagcacatgctgcctaaccattggtgaaggaactgcctcccacacccacctcccactgtttccaggcagcagcctgctgcagatgcagagttcttgggaaacctctactagggcagtgcagaaggaaaatatggacttggagcccccacatagggggctaccaccgtccagaccccagattcacagacccaccaacagctggcaccctcagtgaggaaaagctacagaccctcaataccagtcccgcgcatgagaacagctgaggagctaaaccctgcaaaccacaggtgcactgccctagtagagggttttccatgagtccctcactctgcagcaggctactcctccttcctactaccacccaccctcccaccactctactaccgacccactcctcccaatcctacccatcccttttaccttccaccaccaccaacctcccgtccataattaagtcacccgcttcaacattagggattacgattccgcatgagattcatagggacacacagccaaaccatattattctgaccctgatatcccagaatctcatgtccttatcacagagcaaaatgcaatcatgacttttcaaaaatctccaaaagtcttaacgcattccaaatgtaaaaaaattcaaagtctctcctgagacaaggctacagtctcttctgcctatgagtccctgaatttaaaatggagttcttttctttccaggtacaatgatggtatgggcattgggtaagctttctcagtccaaagggaagaaatttcccataaaaatagcacaaacgggcccacaggcccaacacaagtccaaaactcagcgggacagtattcactcaatcccacagctgcaaatatcatcaggagaactcactatcacacaggcggcattaaggagatagtgtttaaacatttgtgaaggatctgccccctacccttaccttttacccccacccacaaaataatctcccccattctccccacacccctacctccaacgcccactcttctccatgaataaatcacctcacaccaggccccacgtttaacattcaccattacaattccaaatgagtttggtagggatgcagacccaaatcgtattattctgaccctgaccccccatatctcatgttgttctcacactgcaaaatacaatgatgcctactctacagtttcccaatgtcttagctcattccagcatttactgaaatgtccaaagcccaaagtctcttctgagacaagactgccatcccttctgcccctgagcctctgaaatacaaagcaagttaattacctccaaggtatgactgtccaggcattgagtaagaacctccacccgaaaggaagattttttgccagagagaagaacaaaacacaaacgggacttacaggttcccatgacattccaaaacccagcaggccagttattcaaacctacagctccaaaatcattctttttaaattcttgtcccacatctaggacacaagggcatgagggctgggctcccaaggccttgggcagctctgcacctgtggctttgcagtgttcagcccccgcagctgccctcatgggctgtgctgctgttgagtgcctggagtttttaacccatggagggtacgaagcttttgatgggtctatgaacctggggttggcacgatggtggcctccagtgtgggggctccaacctcatattttccttctgcactgcccaagtagaggtttcccatgagactctgcttttttggcagccttctgtctggacaccaggcatttccatacatcttccgaaatatatttatatggaggctcccaagtctctagactagtgctccgtgcacccactggcttaacactatgtagaagccaccaaggcctatagcttgcaccctctgaagcagtgacccaagctgtacctgtgcatctttcagccaaggtcggagcaggagccggggctgctgggatgcaggcagcagtgtcctgaggctgcacacagcagcagggccacggggctggcccagcaaaccattcttctctcctaggtcccagggcctgtgacagcaagggctgctgcaaacatctctgaaatgcctccaaggcttttccccacaattgtcttggctattagcactggcctccactttatgcaaatttctggagacttcatgaattttccccctgaaaatcagcttttctctttgacaacttggccaggctgcaaatgttccaaacttttgagctctgcttgtcatttaaatataagttccaacttgaggtcatttccttggtcacacatgagagcgcaggctgtttgatgcagacaggatccctcttgtgctatggtgcctagaagtttattccaccagatatgcactaaatcatcaccctcaagttcaaagtttcacagatctcaagggcaaggtcgccctgcagccacgttctttgctacagcaaaacaaaagtaaccatggctcctgttcccagttaagttcctcattttcatctgagaccttgtaagcctggccttccctggccttccttctgtcagcattttaatcaaaactatttaacaagtctctacaatggtcccaactttccctcatcttcctgtcttttttcaagctctccaaactctccaacctctggctgttacccacttctgaacctgctttacattttcagctatctttgttgcagcctggcgctcctgcctttcacccgtaaccccaaacacaatcccaatcccccacaactctccccacccccccaataccctccaactctccccatcctcccccccatccaacctccactctccaccaggggaaacttcaagaaggcttcagatatttgcgttaaaaagaagcccagtgctaacagccaaaacagtggggaaaagtcattgaagatatttcatagctccactttgcagtacttattttctgtgtggtcataatgaaaaggggattcattggctcatgggtcttcaggctgtaaagaaagcatggtggcttctgcttctgggaagactcaggaagcctcccaatcataccagaaggaaagcagcaatgaaatgtttcatacggcaggagtaggagcaagactcacagaggaaagaggtgccacagcctgttatacaaccagatctcatgagaactcactatcactaagtcagcatcaagaagatggtgcttaaccattggtgaaggatccaccccccaacacacctccaccccctactgtttccagacagaagcctgctgcagaggcagagcctcttggaaatcctgttctgtggcagtgcagaaggaaaacaagggctttgagtcgctctgcaggaggccgccctcctctagaccccagattcatagacctaccaacagttcacaccctcagtatggaaaagccataggcactcaataccagcccagcccataaaggcagccatgggggctaaagcctgcaaagccacaggtgcactgccgtggtagaggttttccatgagcctctgcctctgcagcaggctactcccccttcctactacccaccaccctccgaccaccctacagccagcatactgttccccaccctacccaccccttttttcttccacccccacacctcccatccatgattaaataatctcccaccaggccccacctccaacatttgggattacaattccaagtgagtttttctagaggcacacaaccaaatcatattatgctgaccttgacccccccaaatcccatgtccttctcacacagtaaaatacaatcacacctgttcaaaagtttccaaaagccttaactcattcccgcattaactcaagtgtgaaaagttaaaagtctcatctgagacaaggcccttctgcctatgagtccctgaaattaaaagcacactcctttctttcaaggaacaatgatggtacaggtattgggtaagttttctcaatccaaacggaagaaatttccaagaaaaataacacaagtgggaccacaggcacaatggacatccaaaacccagcaggtcagtgttcattcagtctcacggctccaaaattatgaagagaactcactatcagaaggacagcattaaggagactgtgtttaaccatttctgaaggatccacctccacacctgcctttcacccataaccccaccacaatcccaactctccccatcccccgaaaaaccccccaactctccccaccctccaataccctccaactctccccatcccccccatccaacatccactctccaccatgattaaatcaccttccaccagcccccacctttaacattccccattaaaattccacaagttttgggggaggcacagagccaaatcatattattctgtccctggtcccccaaatctcatgtctttctcacattgcaaaatacaatgatgccttccctgcagtcccccaaatcttaactcattccagcatttactcaggtgtccaaagcccgaagtcttatctgagacaagtctacagtcccttctgcccatgagtctctggattataaggcaacttcactacttccaaggtataatgattgtacaggcaatgggtaagccttctcagccaaaagaaaaaaaaaaaaaaaactgctagaaagaagcacaaaacacagacgggattcataggatacatgaatgtccaaaacccagcaggccagtcactcaatcctacagctccagaatcatcctttttgaatccctgtcccacatccatggtacaggggtgtgagggctgggctcccaaggtcttgggccaatctgcacctgtggctttgcagggttcagcccctgcagcggccctcatggacacagctggtgttgtgtgcctcgtagcttttccatactgagggtgcaagctgcttgtgggtctatgaatctggggtttggagaatgatgcctccctgtgtgggggcttcaaccctatatgtcccttgtttgctcccctagtagaggtttcccaggaggccctgcctcttggaaaagcttctttcctagacatccaggcttttctgtgcatcttctggagtctacacagaggctcccaagcctctagtctcttactctgtacacctgctggcttaacactatatggaaacaatcaaggcttggagccacctctgaagcagtaacccaagctgtacctgtgcatctttgagccatggctggagctggaactacagggatgcagccagcagtgtcctgaggatgcacacagcaatggggccatggagcttgcccaggaaaccattcttctctgccaggccctagggcctgtgacagcaagggctgctgcagaggaccatgaaatgccttcgaggcctctttcccattgtcttggctatttgcactgggcttctttttatgcagatactctaagccttcttcaattttcccccggaaaaccagcttttctttttgaccacttggccaggctgcagattttccaaactttaggtctccacttctcatttcaatagaagttccaacttgaagtcatttcttaggtcacgcataagaacacaggctattcaatgcagacgggacacctcgctaggctgcctagatgttcattccaccaggtacatccgaaatcatcacccccaaattcatagtttcatagatgtccagggcagggtccccgtgcagccacgttctctgctaaggccaatcaaatgtaaccatggctcctgttcacaggaaattcctaattttcatctgagaccctttaagtctggacttcagtgtttatccttctgtcagccttctgatcgcaagaatttaacagttctccacagcggtcaaattttcctcatcttgctgtcttccaagctttcccaactctcctgacctctgtcttttacccacttctgaacctggttctacattgtcagctatctttatcacaacctggtagtgtggtaaaagaagaaaagtccactttcagggggaaaattcatgaaggctccagatagttgcatgaaaagaagctgagtgctggttgccaagaaaaggggaaagggccttgaaggcacttcatagctaccagaatgccaaggggcaaggagacatttcaaatggcaggagtagaagcaagactgagagaggaaagcggtgccacaccctgttatataaccagatctcatgagaacgcactatcatgaagacagcatcaagcacatgctgcctaaccattggtgaagggactgcctcccacacccacctcccactgtttccaggcagcagcctgctgcagatgcagagttcttgggaaacctctactagggcagtgcagaaggaaaatatggacttggagcccccacatagggggctaccaccgtccagaccccagattcacagacccaccaacagctggcaccctcagtgaggaaaagctacaggccctcaataccagtccagcgcatgagaacagctgaggagctaaaccctgcaaaccacaggtgcactgccctagtagagggttttccatgagtccctcactctgcagcaggctactcctccttcctactaccacccaccctcccaccactctactaccgacccactcctcccaatcctacccatcccttttaccttccaccaccaccaacctcccgtccataattaagtcacccgcttcaacattagggattacgattccgcatgagattcatagggacacacagccaaaccatattattctgaccctgatatcccagaatctcatgtccttatcacagagcaaaatgcaatcatgacttttcaaaaatctccaaaagtcttaactcattccaaatgtaaaaaagttcaaagtctctcctgagacaaggctacagtctcttctgcctatgagtccctgaatttaaaatggagttcttttctttccaggtacaatgatggtacgggcattgggtaagctttctcagtccaaagggaagaaatttcccataaaaatagcacaaatgggcccacaggcccaacacaagtccaaaactcagcgggacagtattcactcaatcccacagctgcaaatatcatcaagagaactcactatcacgcaggcggcattaaggagatagtgtttaaacatttgtgaaggatctgcccccctaaccttaccttttacccccacccacaaaataatctcccccattctccccacacccctacctccaacgcccactcttctccatgaataaatcacctcacaccaggccccacgtttaacattcaccattacaattccaaatgagtttggtagggatgcagacccaaatcgtattattctgaccctgaccccccatatctcatgttgttctcacactgcaaaatacaatgatgcctactctacagtttcccaatgtcttagctcattccagcatttactgaaatgtccaaagcccaaagtctcttctgagacaagactgccatcccttctgcccctgagcctctgaaatacaaagcaagttaattacctccaaggtatgactgtccaggcattgagtaagaacctccacccgaaaggaagattttttgccagagagaagaacaaaacacaaacgggacttacaggttcccatgacattccaaaacccagcaggccagttattcaaacctacagctccaaaatcatcctttttaagtccttgtcccacatctaggacacaagggcgtgagggctgggctcccaaggccttgggcagctctgtacctgtggctttgcagtgttcagcccccgcagctgccctcatgggctgggctagtgttgagcacctgtagcttttccacaatgaagatgcaagatgttagtgagtctatgaatctgacgtttcagaatggtgctccctgtgtggtggttccaaccctatatgttccttccatactgccctagtaaaggattcccatgaggctctgcctctttgaatagtttcgacctggacacccaggtttttctgtaaatcctctgtagtctacatgaaggattctgagcctctagtcttggcctttttgcacctgctggctcaacactatgtggaagccaccaaggcttgcagcttgcaacctctgaagcagtgacccaagatgtacctttgtatctgtcagccatggttggagctggagcttcaggtatgcagccagcagtgtcctgaggatggacacagcagcagggccatgggactggataaggaaatcattcttttctcccaggcctgggggcctgtgacagcaagggttgctgcaaaagtctctgaagtgccttcaaggcctttttatccttgtcttggctattagcactcaattccattttatgcacatttctgaaatcttcttgaactttcccacggaaaatcagcttttctttttgaccacttggccagcctgcaaattttccaaacttttaagctctccgtctcatttaaatataagtttcaccttgaggtcatttctttggtcacatataagacacctcagggtgtttggcacagaccagacacctcttgagctttgctgcctaaaagttcattccaccagatacactctaaatcatcactctcaagttcaaagtttcacagatctccaggttaacggcatcgtgcagtaacgttctttgctaagggaaaacaaaagtgaccttggctcctcatcccagcaagctcctcattttcatgtgagaccttctaagcctggccatcactgtccatcattctgtcatctttttaattataactatttaacaagtctctacactggtccaaacttttccacatcttcctgtcttcttccaacacctccaaactctccaacctctggccgttacacacttctcaacctgcttctacattttcagctatgtttgttgcagcctggcaatgtggtaaaagaagcaaagtctgtttcaggagaaaaattcaggcaggcttcagatatttgccggaaaagaagctgagtgctcattgccaagaaaataaggaaaaggccttgaaggcatttcatagctccatttcacagcactaattttctgtataatcagaaagaaaagaggttgaactggctcatggttctgcacgctttaaataaatcatagaggctactgcatctgggaggactcaggaagcctcccaatcattccagaagaccaagcaccaatagtatgttttatatggcagaagtagaaacaagacagagagaggaaaaaggtgccacaccctgttatacaaccagatttcctgagaactctctaacacaaggtcagcatcaagaatgcttaaccattggtggagccattggtgaaagatctgccccctaccacccacaacccccactgtttccaagcagaagcctgaggcagaggcagagctactaggaaaacctctactaggacaaagcagaaaaaaaacaaaaaacaaaaaaaaaggcttggtggccccacacaagaggttaccatcctccagactctctaacctctggccattacccaattcagaactggcttctacattgtcagctatctgtgtcacagcctggcaatgtggtaaaagaagaagggtccattatcaagggaaaaatcaagaaggcctccaatatttgcattaaaaaaaacagtgctaacagccaagagattgcgggaaaggcctagaaggcatttcatatcttcaccttgcagcattgattttctgtatatacataaagaaaagagatttaattgactcacagttctttgggctgtaaagaaagcatagttgtttctgcttctaggaggactcaggaagcctcacaaccataccagaaggccaagcggcaatgaagtgtttcatatagcaggagcagaagcacgacagcgagaggaaagaggtgccatatcctgttatgcaacttgacctcatgagagctcactatgaggagatcagcatcacaaagacgatgcttaactattggtgaaggatctgccccccaccccatatccacccctcactgtctccatgcagaagcctgagacagaggcagagcctcttggaaaacctctactagggcagcgcagaaggaaaatatgggtttggagcccctatgcaggaggccaccatcctccagaccccagattcatagatgcaccaacagcccgcaccctcagtatggaaaagctacacacactaaacaccagcctagcccatgagagcagccatgggggctaaagccacaggtgcactgccctagtagaggtttcccatgagcctctgcctctgcagcaggctactcccctcccacaacatgccaccctcacaccaccctacagccaacctactcctccccacctaacccacctctttgtacttccaaccccacccctctcccatccatgaataaatcacctcccaccaggccccacctgcaacattcaggattacaattccacatgagtttaggtagggatacacagctaaaccatattattctgaccctgatcccctgaatatcatatccttctcacagagtaaaatacaatcacgccttttcaaaagttgctgaaagtcttaagtcatttcaacattaactcaaatgtaaaaagttcaacgtctcacctgagaaaaggctacagtcccttttgcctatgagtccctgaatttaaaagggagttcttttctttcaaggtatgatgatggtagaggcattgggcaagttttctcaatccaaagggtttgagattgccaggaaaataacacaaatgagatgacagggccaacacaagtccaaaacccagaaggccagtatccattcaatctcacagctccaaaaccatcacgagaactcaccatcgtgaggaaaacattaaggagacagtgtttaaccatttgtgagggatcctgcctccaaccctacctttcacccctcacctccaccaaaatccacccattctccccaatccccaccttccaacacctactgccctccatgattaaatcaccttcaacttggccccacttttaagatttccaattaaaattccagataagtttctgtaacacacagccaaatcttatcattctgtccctgcctacccagatttcatgtccttctcactttgcaaaatgaaatgatgcattacctgccatttccccaagccactatgctttttttacagcctgcagaactataagccaattaaacccctttttgttatgaacacacaaaaaattagtactgtgaagttaagctatgaaatgccttcagtgacttttccccatcgtcttggataagacccccaaggtcttaactcattccagcatttactcaaatgtctgaagcccaaagtctcaactgagacaaagctgcagtctcttctgcccctgagcctctgaaatacaaagcaggttaaccacttccaaggtacgattgtccaggcatttagtaagaatctccacccaaaaggaagatttttgccagagagaagaacaaaacacaaacaggacttacaagtcccacaaaattctgaaactcagcaggccacttattcaaacctacagctccaaagtcatcctttttaaatccttgtcccacatccagggcacaagggcatgagggtgggctcccaaggccttgggcagctctgcacctgtggctttgcagtgttcagcccccgcagctgccctcatgggctgtgctggtgttgagtgcctggagtttttaacccatggagggtacgaagcttttgatgggtctatgaatctggggtctgcacgatggtggcctccagtgtgggggctccaacctcatattttccttctgcactgcccaagtagaggtttcccatgagactctgcttttttggcagccttctgtctggacaccaggcattttcatacatcttctgaaatatatatggaggctcccaagtctctagactagtgctccgtgcacccactggcttaacactatgtagaagcaaccaaggcctatagcttgcaccctctgaggcagtgacccaagctgtacctgtacatctttcagccaaggtcggagcaggagctggggctgctgggatgcaggcagcagtgtcctgaggctacacacagcagcagggccatggggctggcccaggaaaccattcttctctcctaggtcccaaggcccctgacagcaagggctgctgcaaacatctctgaaatgcctccaagccttttccccacaattgtcttggctattagcactggcctccattttatgcaaatttctggagacttcatgaattttccccctgaaaatcagcttttctctttgaccatctggccaggctgcaaatgtttcaaacttttgagctctgcttatcatttaaatataagttccaacttgaggtcatttccttggtcacacataacagcacagactgtttgatgcagacaggatccctcttgtgctatggtgcctagaagttcatttcaccagatatgcactaaatcatcaccctcaagttcaaagtttcacagatctcaagggcaaggtcgccctgcagccacgttctttgctacagcaaaacaaaagtaaccatggctcctgttcccagtaagttcctcattttcatctgagaccttgtaagcctggccttccctggccttccttctgtcagcattctaatcaaaactatttaacaagtctctacaatggtcccaactttccctcatcttcctgtcttttttcaagctctccaaactctccaacttctggtgttaccgacttctgaaccgctttacattttcagctatctttgttgcagcctggcactcctgcctttcacctgtaaccccaaacacaatcccccctaactctccccaccctcccaataccctccaactgtccccttcccacacatccaacctccactctccaccaggggaaacttcaagaaggcttcagatatttgcattaaaaagaagcccagtgctaacagccaagacaatggggaaaagtccttgaagatatttcatagctccactttgcagtacttattttctgtgtggtcataatgaaaaggggattcattggctcatgggtcttcaggctgtaaagaaagcatggtggcttctgcttctgggaagactcaggaagcctcccaatcatatcagaaggaaagcagcaatgaaatgtttcatacggcaggagtaggagcaagactcacagaggaaagaggtgccacagcctgttatacaaccagatctcatgagaactcactatcactaagtcagcatcaagaagatggtgcttaaccattggtgaaggatccaccccccaacacacctccaccccctactgtttccagacagaagcctgctgcagaggcagagcctcttggaaatcctgttctgtggcagtgcagaaggaaaacaagggctttgagtcgctctgcaggaagccgccatcctctagaccccagattcgtagacctaccaacagttcacaccctcagtttggaaaagtgatagacactcaataccagcccagcccataagggcagccatgggggctaaagcctgcaaagccacaggtgcactgccctggtagaggttttccatgagcctctacctctgcagcaggctactcccccttcctactacccaccaccctcccacaaccctacagccggcctactgttccccaccctacccaccccttttttcttccacccccacacctcccatccatgattaaataatctcccaccaggccccacctccaacatttgggattaaaattccatgtgagtttttctagaggcacacaaccaaatcatattatgctgaccttgacccccccaaatcccatgtccttctcacacagtaaaatacaatcacatcttttcaaaagtttccaaaagccttaactcatttccacactaactcaaatgtgaaaagttaaaagtctcatctgagatcaggctacagtctcttctgcctatgaggccctgaagttaaaagggcattcatttctttctaggtacaatgatggtacaggtattgggtaagttttctcaatccaaagggaagaaatttccaagaaaaataacacaagtgggaccacaggcccaatgcacatccaaaacccagcaggacactgttcattcaatctcacagctccaaaatcatgaatagaactcactctcagaagggcagcattaaggagatggtgtttacccatttgtgaaggatccacccccactcctgccttttacccataaacccaaacacaatccccccaactctccccaccccctcaataccctccaactctccccatccctcccatccaacctccactctccaccatgattaaatcaccttccaccagcccccacctttaacattccccattaaaattccacatgagttttgggagaggtacagagccaaatcatattactctgtcctgggtcccccaaatctcatgtctttctcacattgcaaaatacaatgatgccttccctacagtcccccaaatcttaactcattacagcatttactcaaatatccaaagcccaaagtcttatctgagacaagtctacagtcccttctgccatgagtctgtgaattataaaacaacttaactacttccaagctacaatgattgtacaggcaatgggtaagcattctcaaccaatagaaaaaaaaattgctggaaagaagcacaaaacacagatgggattcataggatacataaatgtccaaaacccagcaggccagtcactcaatcctacagctccagaatcatcctttttgaatccctgtcccacatccatggcacaggggtatgagggctggtcttcctaggccttgggcagatctgcacctgtggctttgcagtgttcagcccctgtagctgccgtcatggacagggctggtgttgagtgcctgtagcttttccatactgagggtgcaagctgtttgtgggtctatgaatctggggtttggagaatgatgcctccctgtatgggggcctgtgacagcaagggctgctgcagaggactgtgaaatgccttcgaggcctctttcccattgtcttggctatttgcactgggcttctttttatgcagatactctaagcctccttgaattttcccccggaaaatcagcttttctttttgaccacttggccaggctgcagattttccaaactttaggtctccacttctcatttcaatagaagttccaacttgaagtcatttcttaggtcacgcataagaacacaggctattcaatgcagacaggacacctcgctaggctgcctagatgttcattccaccagatacatcctaaatcatcacccccaaattcatagtttcatagatgtccagggcagggtcaccgtgcagccacgttctttgctaaggccaatcaaatgtaaccatggctcctgttcacaggaaattcctaatcttcatctgagaccttttaagtctgaacttcagtgtttatccttctgtcagccttctgatcgcaagtatttaacaattctctacagtggtcaaattttcctcatcttgctgtcttccaagctttcccaactctcctgacctctgtcttttacccacttctgaacctggttctacattgtcagctatctttatcacaacctggccgtgtggtaaaagaagaaaagtccactttcaggggcaaaattcatgaaggctccagatatttgcatgaaaagaagctgagtgctggttgccaagaaaaggggaaagggccttgaaggcacttcatagctccacttcatagcactaattttctgtatgatcataaagaaaagaggtttaattggctcatggttcagcaggctgtaaaggaggcagagtggcttctgcttctgggacgtctcagggagcctcacaaccataccagaaggccaaggggcaaggagatgtttcatatggctggaatagaagcaagactgagagaggaaagaggtgccacaccttgttatataaccagatctcataagaactcactgttactaggtcagcatcaagaagatgttgcttaaccattggtgaaggatctgcctcccacccccatctcccactgtttccaggcagcagcctgctgcagacgcagagttcttgggaaacctctactagggcagtgcagaaggaaaatacggacttggagcccccacacagggctaccaccctacagaccccagatttagagacccaccaacagcttgcaccctcagtgtggaaaagctacaggcactgaacactagtccagtccatgagagcatccatgggggctcaaacctgcaaagccacaggtgcactgccctagtaatggttttacatgaggctctgcctctgcagcacgctactcccccttcctactacccacgaccctcccaccaccctacagccagcctactcattcccaccctacccacccctttttccatccacacccacccctgctcatccatgattaaatcacttcctccctctccctcatctttctgtcatgctctaatccctccaaaccctcccaatctttgtttgctacccactactgagcctgcttctactttttcaggtatctctatagcaggttggctatgtagcaataacacaaaaccccatttaaggggaaaaattcaagaagacttcagaaatttgcatataaagaagccctgtgctaatagccaagacaaagggaaaaaaggccttgaagacatgcacagctctctcggcagttctaattttctctattattgtaaatgaaagaggtttaattgaatcatggttttgcaagctgtgaaggaagcatagtgtcttccgtttctgggaggaatcaagaagcctcctaattataccaaaagccaagacaatgagatacctcctaaggcaggagtaggaggaagacagagtgaggaaagaggttccacagccttttaaacaaccagatctcatgagaactcactcgctatcaggaggacagcatcaaggtgatggtcctttatcattcgtggagaacctacccgcacccttttataactaaatctttttccacctaggccccacctctaacattagggagtataattccacatgggttttgatacggacacagagacaaaccatattattctgtccctgatcccatgaatatcatgtccttctcacattgcaaaatacaatcatgccttgccagaatgagtcttaactcatttcagcattaactcaaacttacaaagtccaaaatctcatctgagtcaaggctacggtctctttttcctatgagcctctgaattaaaaagcaagctcacagcttctaacgtataatgatggtacaggcattgtgtaagctttccatattcaaaaggaagaccttttccagaaagcttcttatttctatctgagacctcctcagcctggccttcactatccatgtttgtgccaggatttttatcacaaccatttaaccagtctctaagatagtccaaaaattttctcatctgtcttcttttgagacttccaaactcttccaacctctgcccattacctagttccaaagctgcttccacattttcaggtatctttatagcaatgctgcaatcgtcatttgccattttctgtttgattcattttgaaaaagaggtttaattggctcatggttctgcagggtggacaggaagcacagggcttctgattctgggaggcctcagaaatctttcaatctttgtacaaggcaaagaaagagtgagttgtctcacatggcaagaggaaaacacgcagagtagggaggtgacatagttttcagtggccagatctcacgagaagtcactcatgattgtgaggatggtacaaggggatggtgctgaaccattcatgagaaatttgccttcataaatcaattgccttataccaggatccaccttccacattaggaaatataattaaatatgagatttggtggggacacatattcgaattgcatcatcagtctttgagtataaagacatgcacagcaggctttatccagccaacttatttgggactctttatagggtttgtggtctacagcatatacactaaaatattcatacttcaaagagcagtaaagtggtattatcattcttccaaaagtcccaatggtagtttaggcattcatggcatgatttagttcatgtttgctactgtttctattctgtcaacatattaactgtttcctacacaattctgtattcagctggatttcagttgagcacaaaaccatccttgtgctaccacggatagctggcactagctccttgctagtgttattattctgtgtagaaagtatccttgaactggaaacagtccacaatcaaatatctagtcattcaacattatcaattcctggatgatttttgaaaaaatagtatctcttgttgcaagaaatgctgcatctgtgatttcatgtctctcattcaaattggatggaagtggtgaatttccactgaagtggtgaaagaattcctgttcctgtgattctggtgtcatcagcctctgcatctctatcttcccttctgccacatgttgcctgtcctccgcgactttggtaagaacttgcttgtgtatgtggatgatgttcaggatgttggtctggtgtccctgagacagcactaacaggtccatgactgggtccaggttctgcctgggatgattggcaaagagctcactgacagtgttgaaggcatctgtggtgaagtggatgggctggtccagctccaaggcctggctgaggctgaagaactggcagccttctgatgctccttcttaaagcctgtcaccatcacctgcttgcatgtcaactcattggctgtgaagttgagccgagtgccctgttgttcatcttcttggtgaagcatttgaagctgtcaatcttgctctcccactcctaaagtttgagtgtcaccctggaggtgggctcagagccagggagaatctggcactcaccatctcatccttctcagcattcctcttgccctgtctccaggctgtctcttcagtgctggtgtggcacatcaggaagtgatggaagatgtggcactgtgcctgcacccagaagctggccatgtggttcatccaccagattgggccctttctgcacttgaacatagaatcctcctcaagagggcctgtggtctgcctcttggcacccaagaagcccacagtgctgtaggagccctgatgcatggattggagccccaaaggcagcgcaaaccctgctcctgaggctgctgctcatttcctctatgtggctccatttgcagcacagttgttgaactgaggcttgtgcatgccaggcaaggccaagttggctcaaagagcaaccagccacctctgcaagggtgtaccaggagcaggtggaccagccaccaacctcacttgctgccaatcggggtaaatcagttattctgccctggaggtagggccccagtgccatctgcttttcctcaggcctccacttcatcagctgtcaggtggtggtcactcagggtgtgggaacctggccatccctgtttccttgagtgggtgaggttggtggctggtccacctgctcctggcacacccttgcagaggtggctggttgctctttgagccagcttggacttacttggcatgcacaggccccgggtactgacaagctgctccgagtgagcttgtcttgtcttgggccaaattctaactctggccagggccacagaaggctgagtcccctgggtggtaatcctggctgctgcagggaggcccatggtgctcctcccctcccagggctcaggatgaggttcaactaggacaggaccctttaggtatgggacttgtgccccaggagggggcctctgtcacacaggttgggtaagatgtatggcatgctgctggcttccagggctgttgggatgacacattcacccttccctccagggacctcaaaatgaccagcttcccctttgagaatgacttcccaaggcctaggagccatctggggctgcagggcagctggctgcatgctgccctggcttcttccatgtcgtgctggtcactacccaccaaggggggtcagatgcaggcaccatgcagggcagttgtctctggacctgcgtctttgttatcatggagctggactgggcctgggtgagagggcctgatggggttgtcctgggtaatcacgggggtgatcagaaaagatgcagaatggaattgctgcgaggatgaacgagatgactgtcagcacagaataggcagccggtgagtgttcagggattaccctcagtagctgctcagaggccaaaaccacccaactgatagcgactgtccccaagctaggagcaagagaagagagcaggtcccactcacctgagtctgatcagtcagctgtgttgagatgtgcctctcacctagaaaacggtccttcacgcagagccactcagacaccacagtgtgtctctaactgctccacaacacagaggcgatgggggctcagcaacagtgacattgtggggtgacacaacccaccacaatgggagcctgcatgggtcaacagcgcccagagtcagtgtcctctatcccctgaactgacatgtgtggatgcagtgtgtttgtgcatgcgtgtgtgcctgtgtgtgtgtgtgcacatatgtgtgtgtgtgtttctcttgcttctctggccaggcctagcttctccactcacaggtgcacccaggtcatcaccgagggctcatggccagcattagagcttctacaggtgctccccaatctctgccttccccacccatggtggtcctggggatgcagagagaggaggggcaccaggcacagcagagagggctgggaccccctctaggtggcacacaggtcatgtgtaaagttgtaggtctgccaagtggtgctggattcaacacatcttctcaccttctctttccagccaccctccaaggtgccctgactcaccttccctgcagatggaggcaaggagactccacagacaaaccccctgcctgaggtcacacagtggccagctggccaggttcctactgaccagccgcccaggaccagtttcccactgatgaggcctctaatgaccactcctccatttaccagttcccactgaccaagtccccactgaccatgtcttcctaaccaggctcacacttaataggcctcataggccagacctcactgaccaatttcccactgacctggtccccactgaccaggttcccactgacaagaccacagttgaccaagtcgctgctcacctgacccccactaaacaattttccatggatcagtccccagctgaccgagccccctctgaccagaccctcactgacgaggctccaagccactaaggccccacactgaccaggcccctagtatactgcataggccccaccagtttttcattgtttatgttccagcccatcaggcctcactaagaagaccatcagtgaccaggtccccatgaaccgggcttccaatgactaggtcaccaggtccccactgaggaggcctttactgaggaggccaccactaaccaggtcccaactgactaggtcctaatgaccaggtcatctctgagcatggtccactgaccaggcccctgagcagcgtgctcaaagtctcattacaatgcccccctcagcccacagaccctccctccctgtatgtgtgtccagaggtcaggccctggggttttttttgggacatggcttttcctccaagacagagggagagacagctggcctcaggctccaggtgcccagctccacactcaccccaaaagccctctgggccaatctcaaaggagatagtgaggtggcctggcactgcctggacatgccatgtagcctattcctgagtgtcagagtgggaggaaggcagggacatttggcagatgagacatcttgtgctgttgggcatcccagggcccttcccacagagtcccgatctacagacacagcacagaggctacaggaagactaatgcaggacccttgaggctgagccagggaccacatgaggactgtgcccagacagccagaaggccctttgctagtttcttggtacctcatggatgtggcagcggttgttctgttggggaccagtgagcacgtgctggggagggctcgcctgtgcttcctcagtggctccacctctgcttctaagaaaaatcactcattccatggctggagcagagaaaatacaacattagcttagaacatcttgttcctgaaactaaaaaagtgctgacagagtaacgaagacaaataaaaaagacaagaagtcagcttgaaatgtctaccactggcctaatcttggggaattggagcaccagaatcatgagctttcccttctcagttatttattggttttacttctccaggtacagcaaagaagagaagaaaataatcatctggcaaccatcatagtaataattgttcaaacacaagtcatccatgaaatgctaaatctagtgggttctgggagtaactggatatttacagagcctcaaagtatctccccacaaaatacggttcaactacaaaaagaaaattgtcacattagcatgcacaagcctggcaggtactccttaactcccctaagtagtaaaagctgtaaaatgcaaagaagccttcgatgacctttactaaagtatcaatgatgacttcgttctttggctgtttaaacagctggcatttgggcaatttgagtacgtcaaactcaataatactggtgttcatttgcaagatccacttaaaacttaaggaggctaaaaaacatcatttaaattaccctataaattatcatcacacatgtgatacaaaaacatcctacttcagtaaagattgtaatgttatatattttatgagaaacaattaaaatgttgtgtaaacagcccagtaataaagttttataatcttttaaataataaaatttttccttaagactttatggttaaacattctcttcattagatgtggcttaccagtggattatagagaagtaagtagacgggagcaagtgttcaacacagcaacaactggaaagagaaagaattatgttctttacctaaaacacttcagttaactaaatgtgagtttaaatactaaagagttgagaactttatcagagttagtaagaatgagaaatatctatgtacatttacaatacaaaattactattaaataatttacacatggcattaattctattgtgtttaaatattagaggtttttcattcttcattcatgtaatcaacagccacgtgctaaggtactagaaccagcactggaattccaagatgaagatggcatggtccacctcccaatagtcatatgctataacctaaaaacacagacaggtaggcaatgtccacatagtgtcatagataccatgacaggtatacagcagggcactactggaacacacaaaagggacatctatcccacttttatgtcaatatcatgggctttctggtggaggagataacataggttgatacctgaaggacaaggaaaagcttgccagatagagggaagaggcgaaggcaaagagcctgaggtgaggaagagccctgcggagttctactctcctccactttggtgctagagcaaagggtagagtgcggtaagtggcaaaaaacaaggctgagtaacttgacaagaatcacattgacgtgggtgtttttatttcatggtgaaaaatttggaacttttcctgagaacagatgtaagccaatgacacagtatatgataggagatttaaaatgtcacctgtcaagtgactgcttatgaagggttattgcccagctaagaatttcaaaatgagtctgaggtctgttggccttcaatctgtaccaaaaccctgagaacttggtgatgcctttgttttctgagaatcgtttcagtgtgctggctgacagttccatgatgatggcaaaacttaagaaagtgtagagccagtaaaaaacagatgcacagacttcttgggaattttttaagctatggaacatgatgaatttatagtgcataagtacagtcttctctgtgaaagtttttgttttcacatcttgcattagatgtgtgtaagaaaaaaaatacttgacatagtatctactaaccaaacaatgaaaaggaatgccatttgttatttacacttaatttctaaaataaacctaaatgtaattaataaattttggcaacatacttctctttgtttctctagttatttgttctacacagtccagctccatctaaaataagtaaaaataataataatgtttaagttaaacaagaaacattatcatgcaaataatgtatcacttacaaaatgtgacctttagtatttttagtgactagacataacttgaagtttgcttaaatagaaaaataatcacataaataaagtaaaatttctacttattttaagtttagataacagaggatgcacctgtgtaatgctgtttagagtaatcagacaaaaatacagttaatattggtctactgcatatacatgattttagaaaggtagtgttttattagtacaaaggttaaacaatggccaggtgtggtgactcatgcctgtaatcccagcacttggggaggccaaggcaggcagatcatgaggtcaggagatcgagaccatcctggccaacatggggaaactctgtctctattaaaaatacaaaaattagctgggcatggtggtgcacacttgtagtcccagctactcaggaggctaaggcaggagaattgcttgaagccaggaggtggaggttgcagtgagccaagattgcaccactgcactccagcctggtgatacagtgagaccttgtctcaaaaaaaaaaaaaaaattaaataattaaagtcatcttttcaatgaatgcattgctttgaaattcttagcaaaactctgccctttatacaagtttaatccaatttttttacatcaataaattttatcttaaaaagaaatttctattctctacttatagtaaacttttttaatagtaaatttttcttgttttttttttgtttgtttttttctagtttgtattctaaattaaggtggtacctgtgtaggcttcttccaagagaatattgagggatgccaaggtttagagtacagtggaacccatcacacaggtagtaagcataggacccaataagtagttttccaaccctggcccactctgtccctccctgttcttatttcccagtgtctattgttcccaggtttatgacaatgtgcacccaatgtgtagctcccacataagtgaaaacatgagatatttggtttctgtttctgtgttagtttgcttaggatagtggattccagctgtatccatgttgctgcaaaggacatgattttgttcttttcttggctgcatagtattccatggtatgtatggaacattccaatctaccttggattttcaatctgccttggatgcacctggattgactccatgtctttgctgctttgaatagtgctgcaatgaacacacatgtgcaagcatctttttattacaatgatttattgtcctttaggtatacccctagtatagtaatgggattgctgcatccaacggtcatccttagttcttaatttccaaactgctctccatagtagctgaattaatttacattgccacaaacggtgtgtgttcccttttctccactgcttccccaacatctttttttttttctttttacttttcaacaaaagttattctgactggtgtgaaatagtatctcactgatgttttgtttggcacttttctgatgattaacaatggtaagcatttgttaatatgtttgttggccacttacatgtgttattttgagaagtgtctgttcacgtcctttgcccatttttaatggtgttatttattttttgcttgttgatttgtttagatctcttatggattctggataataggcgtttgctgtatccatagtttgtgaatattttcttccattctctatgctgtctgtttaatcccgtgatagtttctcatgctgtgcagaagctctttagcttaattagatcatacttgtcaatttttgttattcttgcaattgcttttgaggactttgccataaattaattgagaagtatgaagtccagaagagtatttcctaggttttcttccaggatttttatagtcagaggatgtactcttatgtaagaaaagcacaaaccttttttttttttttttgagacagagtctccatatagtgcagtggtatgatcttggttcactgcaacctctgtctcccgggttcaagtgactctcccgcctcagcctcccaagtatctgagattacacatgcctgccaacatgccttgctaatttttgtatttttagtagagttgggtttcatcatgttggccaggctggtctcaaactcctgacctcaggtgatccacctgcctcggcctcccaaaatgttgggattgtaagtgtgagccacggcacctggccaagcacaaagctttgaacataaaaatggaaatgaacattttagtgttttgtttaattcataaaatgcaattattttggattctactaaataataaacatctatatgtggtaaactgtttggatgccaatcattcagttgtgattatgggtgggaagagttgagatggtgcaaataaacttttttttaaattttttatattcaagatgaagtctcaccctgtcactcaggctggagttcagtggcacgatctcggctcactgcaacctccgcctcctgggttcaagcaattctctgcctcagcctccctagtagctgggattacaggtgctctccaccacacctggctaattttttttttctactttttgtactttcaccatcttggccaggctggtcttgaactcctgacattgtgacacacctgcctcagcctcccgaagtgctgggattacagacatgagccaccacacctggctggtgcaaagaaactttaaaagtgacatgggctggacgtggtagctcatgcctgttatcccagcactttgggaggctgaggcaggcagatcacaaggtcaggagtttgagaacagcctggccaatatggtgaaaccctgtctctactaaaaatacaaacattagctgggtgtaatggcaggtgcctgtagtctcagctacttgggaggctgaggcaggaaaatcgcttgaacctgggaggtggaggttgcagtgagccaagatggtgccacaacactccagcctgggcaatagagtgaaacactgtctcaatttaaaaaaaagggggggcagtatgaaccacagctaaactataatcaattagagagtaagccaaagcatctcaaactatatcatcagttatcaggcaataatatgcaatttctaaaacctaacttaaatgcagcttttaaagacattttaaatgtgtcagtttagtcacatttatggaataaagttagtaaacgggtatctcttgaaaatgagagctccagggaattaaaaaatgtaaagttcccatttcctttctgtgttaacacagctaattatgatctttacaaaacatgcataagtcaacagaattcagtatttcaccaaattaaaaacaagaattatattagagaaatgaaacccaaaagagaaatggtcatgtaactaaccacagtctaggagttcttgcagttatttgaagtctgtgggcttgaaataggaattcttatgggtgtttggggaatatattttctgttgagtcctatactagtaagattttcaacacaaggtgactctgggtctcgccttgtaggaagagcactgagaaaatatttcatctgctctttctccataaggagcttcatgctgatcactgctattttcttatttgatctgtaaagatagcaaagacacacgcttagtatttcatttttcctctaatgattcttaatgacttgcagtttttaaaaacttgccctgagagcaaaccaaattatccactaaacagtgttttcacactgaagatgtgtgagagcatacctgttgtaagcaagtataattttaaaatcattctaaagaagcacctgtgtttctaaggtgatttatactgaacaagcagtacaaacaaagtagacagggaagagaaatggctatcagtgatatatggcttgacaggtaacacttgctgccttctaaaagggctctacttgtgagattctgaagattccattagaaatactcatatttaaagggtaacaatgtgagaaaagaatatgttgatttgcttgattataagaaccacttcactagaaataattgtatcaaaacatcatgttgtactccttaatgtaggttaagaaaactaaaatgaacaacaacaaaaaaatttaggaatacttgtgtttagcaaacaaattttaggtttcacccttgtgcatttcacccattatctaggaacaattaagcatttggcactgaggaataattcagaacaacaactcctgggggagaactagattggctggttggtgatcaaaaagaactaaagcatgtctgaaggcaattagcgcccagcactgtgaccaaggcactggaggtggggctttttccttctgccttccacacaccccttcaggctgaacaagtttttttttttttatactttaagttttagggtacatgtgcacaacgtgcaggttagttacatatgtatacctgtgccatgttggtgtgctgcacccagtaactcatcatttaacattaggtatatctccaaatgttatccctcccccatccccccaccccacgacaggccccggtgtgtgatgttccccccttcctgtgtccatgtgttctcattgttcaattcccacctatgagtgagaacatacagtgtttggttttttgtccttgcgatagtttgctgagaatgatggtttccagctccatccatgtccctacaaaggacatgaactcattatttgttatggctgcatagtattccatggtgtatatgtgcgacatttccttaatccagtctatcattgttggatatttgtgttgcttccaagtctttgctattgtgaatagtgctgcaataaacatacgtgtgcatgtgtctttatagcagcatggtttataatcctttgggtatacacccagtaatgggattgctgggtcaaatggtatttctagttatgttttaaccactttgtgaattacacttctttaaattccttgataattattccctatttcacaaggatgcctttctgtaacatcttgaaaatgttacacaaatagtctttcttgaggcacgctctagtgataatactaaagatcacaatcaaaaatgattgtgcccggagtagcagtaccacttgaaactttgggtttaggttgtgatctaccaaaaaataaattaaactcattaatatttctatttaggaaaattctgacaagcaattttataacaagatcacattattaattataaagcttcgaaagtacttagtgacaaaaactaacagatcaggttaactacatgagacttttcaggggaaaaaagccatacaaaagcaaaaaaaaaaagagagagagagagaaagaaatgggacagaaactatccttgactaacattttaaaggtaagattatttactaacattattttctgaaattacattattagattagcattcacttcctactaatctcctgaagccatctcactaaaaattatgctttcaaaacaaattaatgagcttaattcattttctatgagtgtatgttttgacttactttgttaatttttttgacatggaattgttagctttcaatgctgctgcaaaggcttccttatattcttctaattcggttgtaacctcttcataagcagttttcatttctgagaatttacattccacatctttaagtgtgagttcctttttatttagtgaagccatattatccttgtttaactgctctaattgtttttcatattgtgcttgttcctaaaacaaaggaaaagaatacacttttaaaacaattataacctaattattatatgtttgttgcctttcattttgagtcagtgattcaaagagcaattgtgaatatgttagtaaaagaggctgaagcttaaaatatttatcagcaagttcaaaactaataactgaattcagaattgtctgatttataaaaatttgaaatcataattatgttagtattaatgtaatctggtcatataaaaagtaatagaatccattcataattttaaaaagtgattaatgaacaatgtagcttaagaccaattcaaaagtatcacataattttgaaatcacaattgtttcttatgccaactgatcttaatcatcaaatgactccacagtgagaatcattactctgaaagattgattttgttataataataatggaaatgtaaatatttaaaagaaaaaacagatgccattttttttctagaactctacaaagcaaattgctacaagagaggcagaggaaacataatatatacatatccaaaatataatttgcggtgaaataaatgaaagcacattacagataaacttacctgatttaaaaaactaacctgtaaatggatttcttctaatttttctactgcctgcactgccttttcatctagctccaatttatattcttgtagtttactaagttctaccctattgttttccatatgtgtcttaagatttaatatttcttctttcaacatctttttatcctcctcaagtttctcacattgctgttgtacttttttcatagataaaaactcctgttgaagaacttgattgtctttagccaaattgacacattttgaagataaagcttccttctctgccgtaagatcatcaaactgcatgaataaaataatatagcttgataatgaagtaggctgagaataatctaatacaaaaccaatagcaaattttgaaatgcatttacttgcaataaaatgttatccgtaatgcagtggattcttcaaatgtgaacccttaaattactcagaattttaagaacaaagttaaagctaccatgagtcacaaaaatatattatttgctatcatcatctttgccacagaatttttgcacttcatcttacttttatttttctgataattcatttttgttcctccttagatggcactaagttatctcttagtaaaaagtgtctaaccaccttccctcattatcattccccataatatgtcaaaaaaaagtttcagagatatcatattgagttatttaggccaaagtcaataaatggctctcagaataagactttgaaaataatataacactctatactaggcatggtggctcattcctgtaattgtagcaatttaaaagcctgtgccagaatgatcacttgaggccagaatttgagatcagccagagcaacatagtgagacccccatgtctacaaaattttttttttaaattagcttggcatggtggctcatgcctctagacccagctagttgggagactgaggcaaaaggatggcttgtacccagagttcagggctgcagtgaattatgaccacatcaccgcacttctgcctggatgacagacaaagaccatatctcaaaaaaacacaaaataatgaatcctgtaaataaggattctgatgccataagcctttccttaaactgcaaatgtttcatgctaatttgaattgcattttacgaagtaatgattcttggggtaaaggccatagaatacacacccagaaataaatccacatatttacagccaactgattttggacaaaggtgccaagaacatacactgggggaaggacagtctcttcaaatgaatggcactgggaaaactaaatatccatatggagaagaatgatactagcttcctatgtaacagcacataatgaaataaactcagaattgattgaagactgacatttaaggcctaaaattatgaaaccactctaagtaaatggaggaaaaatgcttgaggacattagtctgcacaaagatttttatgggtaagacatcagaagcataggcaaaaaccaaatgatagacaaatggtattacattaagataaagagcttctgcccagcaaactgagtgaagagaaaaccagtggaatgggagaaaatattgtcaactattcatctaataagggactagtatccaaaatatacaagaaactcaaaaaacttgacagtaaaaaaaaatctgggttcaaaattgggcaaaatatctaactatacttttctttagaaaaaagaaatacaaatagccaataaataaatttaaaaacgctcagtatcactaatcctcagggaaataaaaatcaaatcttcaatgtgatacaatcttgcttcaatttgaataaattgctatcattgaaaagacaaaaaaataacatatgctggtgaggttccagagaacagtaaactctaacatgctgttggtgggaaggtaaattagtgcagccactatagaaaacaacatgaggttttctcaaaaagctaataatgggactgccaagggatccggcaaacccactattgggtattcaggcaatagaaaagaaaacaatagatcaaaaagatacctgtactcgtatgtttattgtagcactattcacaatagctgatgtatggaatcaacctgcatgtccataaccaaatgaatggacaaaaaactgtggcacacaaacacagtagaatactattcaccgtataaaggaattcaatcctgttattcgtggccatgtggatcagtctgagggatggtatgttaagtgcagacacagaaagataaacactgcacattctcactcatatgtgggagctaaagaaaaactgagggctgggcaacatggctattgcctgtaatttcctagcactttgaaagaccaaggcaggagaatcacttgaggccaaagttccagagcaccctggacaacataggtagatagctctacaaagtcaaaaatcagacaggtgcaatggtgcatgcccataatcctagctgctcaggagggtgaggtcagaggatcacatgagcccaagagtttgaggctgcagtgagctatgatcaagccactgtctctagtctgggtgactacagatgcccagagcccagactggactagcaaggccctgtctcttaacaacaacaaaaaagctcacagaggtaggggaggggaggatggttaatggataccgaattacagttagataagaggaatgagttctggtgttctgtggcattgtagggtgaatatggttaactatgatttattgtatatttttaaaaaggcagaagattttgaatgttcacaattcaaaaaatgaaaaatggttgaagtagtaaatgtgctagttagctcgatcattacacactatatacatgtatcaaaatatcactctattggccaaaattatgtatatacatgtcaattaaaacaaaagagaagctatatttatcccattaaaaaaacagaatatgggcaatccttactgacttccttctaatgaatagaatgcagtaaaagggatatcatgtggcttccctatctcagactgctttccctttgaactcagcccccagattgtgagtgagatcaggccagagagacagcctgggagtgtcagtgtcaatattcatgctgcctgctccaaccaaggttccagccaatggccagcatcaaccatcaaacacatgggtgagcaaagcttcagaggattccatttccccaactgatcagctattcctagggaagctgaggggagcagagatgacctgtcctggctaagcttttttcaaaccataggttcatgaacaaaataaatgtttttcttttaagccacaaaaacctggataattgttagaaaaataagttttaaaaagagacaacaggaaacataacttatgcagagaaaagagtctcctttaaagtaggatctaataaatgttgagattaatttattgatggcaaacattattgagaagcagtagataaccaggagagagacataagctgctgaggaggaacatttcctaaaacccccttcaattatgaactctgataacaaggcaagggtgtctccttacaatttcccctcaagttaggaaataagactgcaaagaaagaagaagtatgatttgaaaaacaactagaaatacttggttagataaccaaaatcagacatttgcctgatttcagttaatgaaaattctaaaagaataagctttgagtatttattaatcaatctagtattcaattttcattttccttttctcaatgaggaaataaggagaacattatggaatgatttttagtcttcacagaagtaaaataagcacaatatgctttgagtgttaagacatcaaatgcaatttctcctttatcttacttcaagcttgtttgtatggagaagttaagaccatcccatctctgtattataccacaatgcttctctacagcacacaacttggctccgaaatttcaaaagtcaaaatactaatctactatttgtctctgataaattgcctgaacattacctgattttgaagtgctgcactcctaagactttttcttggaatgagttaaactttatatcccaagaatcctctactgagctagaaagcagagctgtgcatctctgtttcagtaaaaggaggtcaatacagggaactgtggtttctgagaatgcaagatctgcaccaagtaaaggattagatgcagagctacccaagagaaccagctaccaggtggaaagaggatctgcgaactacaacatgatgacttcacatgatttccactgaggaaagctggcagctcagacttctccttcctggatggtaaacatctatggaagattctatgaattataatgagttagcaaaacataatacactaaatattagactacatcagcagatcctgtgatgaaaacttactgaaaatataactatagagggaggcaatggaaaagagactaaaggtttgaatagagaaaaaaagaaagagtgtcttgtaagcctgacttgccatcatgtcttagagtaagtaaggtataagctggccagagattcctttgaggcacaaaaggtgaagttaaagatattccactaaatttaatttttattatgatataagacaactggtaatatgcaacatgcttgaaaaaatcttctcattaaattcaatttggccttggcataagaatagatataaacaaactaagaattgataatctacaaataaacctgcacatttacagtcaattgattttatacaaggttaacaaaagaacagaatgggaaaagaatagtcttttcaacaaatggtgctgcgacaactggatatccacatgcaaaaaataaataaagtacgaagaaaaccctggcataaatctttgtgactgcatttggcagtgttttcttagctatgactccaaaggaaaaatggattcaatgaacttcaaaattgaaaactgctgtgcttgagaagacagtatcaagaagtgaaaaggtaagatactgagtagaagaaagtatttgaaaagcatgtatctgataagggacttacatatgtaggatatataaagaacctttgcaattcataaataacaagataacccaatttaaaaaatgggcaaagattttgaatagatatatttgcaaagaagatataaagatggataataagcacattaatagatgcttaatgtaattagtcattaggaaaaagtaaatcaaaaccacgtgtggtatcacttcacaccacaggatgaaacctttattcaataaaaaagagaaaataagtgttaggaaaaatgtaaagaaattaaagcccttatccaatgctgctggggatgtaaagtggtgcagccactttggaaaacaaactggcagctcctcaaaaggttaagcatgaagttaccatatgacccagaaattccagtcatgagtatatactccagaaaatcaaaaacatatgcaagcacaaaaactcatacgtaaatgtttacagcagcattattaataagagtgaaaagtggaaagaaccaaaatgtccatcacctttgggtgggaaagaacccaaaggtccatcacctggtgaatggataaataaactgtttgatgtatccatacaatggaatatcactcagcaataagaagaaactaagtactgatactgtattaggaggagacagcaaaatgcctaggcagataaggaagggtccccggagaatccccaacaagcctcacaagtgtttacaccagacgttatgtgcagataagggaacctggacttgtcttgcctggacatgccggcagcagacccgaggcccacaagcactggggggatggggtggagtcaccaggaattcacgccttatgcagagcaggagcctggccgcttcagctcctgtgctcctggtattcaattgtgaggtggaaacctgtttgcaggacgcccctctttgctgagagctttcctttcacttaataaattctgtcctcctcacccttcaatgtgtctgtgtgcttaatttttcctggtcatgagagaagaaaccagattgagctgaactaaggagcaaaaaccctgcatcaatacctgctgcaacacagatgcagcatggaaaattatgctaagtgaaataagccagtcacagtagaccacttgcttttcatttcagaggcttataggcaaatctatacaaagaaggtgggtggttacctagggctgagggaggaagggaaaactagtgaagatagctaaatgatgtggggtttgcttttagggtgatgaaaatgttctacaattgattgtaatgatgactgcataactctctgaaaatactgaagttaataaattgtatattttaaatgagtgaattgcatggtgtgttcattatttctcaataaacctgttaccccccaccccaaattaatttggtactagtgattttggtagtagtgatctggagacaggtactgcttggtttcagatcactggccagggttcaaggcctaagagaatcaacagcatgtccttttcatagaaaaagagattgatattttaaaagctatccttttcattagtttcaagtctgtaaaattaaatgaaaaatctttcactgcttaaagcactgacagatttatattgaggaataagaccttgttttccttggccccaatttctatctaaagggtctgggaatcacacccttcaaactatcaaatctcatcagatgggttttattaactcttataatgtggcttcctttctaacctgattctggtgcagcatcacagagagaagaagctgaaggaaatcaaaatattttaccccaaaatatattttttgtcatattttgaaatggctgctgcagggccaagagattgaaatggtcctcattaatgtagcccaatctctccccttctaggtcttcccagatctggggaagattaactaagagcctgaggcattcaaagtctgaaaagatatatttaccctctattttctcaacatattttggcagaatttgggtttttccattatcaatattttccaaaattacatgatttttaataccaaaactgatttaaaattaccatacgttggaatataaattattctattataaagatacatgcatttgtatgttcattgcagcactattcacaacagtaaagccatggaatcaacccagatgtccatcagtgatagacgggataaagaaaatgtggtacatatacatcatggaatactatggagccataaaaatgaatgagatcatgctttttgcagggatatggatgagctcaaagctgatatcttcagcaaactaatgcaggaagaaaaaaacaaacactgcatcttctcacttagaagtgggagctgaatgatgagaacacatggactcggggaggggaacaacaaacactggggcctgttaggatcaggagggagagcatcaagatcaatagctaatgcctgcagggcttaatatctaggtgatggattgataggtgcagcaaaccaacatgacacacgtttacctatataacaaacctgcacgtctcacacatgtaatctagaccttaagataaaataatttttttaaattaccttctgttttagcttcttaatcagaatatccattttcagttgatctgtttttaagtctccatggcaatcaaagtcttcatttccaaatacatttaacatatttattgtcatttccaggagtttcttatatctgcagaaatgtacagaattagtaagtcaagtatttttaagagtaaatatttaataattgtttaaacatctgttatggcatatcaaagaaacaaatctataaactatgttactttcagtttcaactgaacatagtttgaaagcattctatatgaaattataatcttagataaataatatgaagaacaattttatggcatatatggcaggtaaagtgatattatagccatacagtgtttttgttttgttttttgttttgttttgagatggaatttcactcttgttgcccaggccaaagtgcagtggtgtggtctcagctcactgcaacctctgcctcctggactcaagtgattcacctgtctcagcctcccaagtggctgggattacaggtgtgtaccaccacgcctggctcattttgtatttttagtagagacggggtttcactggtcagactggtcttgaactcttgacctcaaatgatccacccacattggcctcccaaagtgctgggattacaggtgtgagccaccacacctggcctaaccatacactttttgtaaataaactactgatatccatgttggtatgctaagtaaaataacgtattactaaatataagccataacccagagatgagtaaccaagataaaaaagtaaaacacatacatttaaaaagacacaaaagtacattttgatacccactgaccacagtctatcagaagaaaaaaaagtacacacaaaaagcatcaaggagatcattcaatgtagaaaaagagaagaaaacatctttaatatctgagttgaggagaaaaaggatacaggcagttttagaaaaaaggaaaggggcagagagatgtgtgacgatttaaagactttgaagaagagatctagacatctttgctgacataatgtcaacaaaatgaaagagatacaaaaccatgtagagaaaagcaatgacagaaaaatgttgattctaatcagaaaaccaaattaagtgctcagtaaataaatagaaaagtagctgtgttcagggcttcaaagacagattccattgttttaaaaaaaatctgtgatcaaaacatgaatgttcattttactttttctttaagttatacgtatatttttatatatatgaaatttatttatgtaaaacaagtttaataacatgtatacttcatgtatacaacagaggtactcatgtacaatgagtaaatttccacgttttatatctaaaagaaaaagcagaaacaaaatataagctacatatcaagataaatttgatgttaaagaatgacacaaacaggtcttctttaaacaatttgaatgcagcagaggatactacaaaaggaagaaaaaatgaccacagacagcaaaaaaatatcttcagaaataaaaattcaaaccagataatgaagagtgcactggacattaaatgtccaaggcgtggtcattgttttcaaaatcattaaagaataagtggctgggcatggtggctcatgtcactttgggaggccgaggcgggcagatcacgaggtcaggaattcgagaccagcctgaccaacttggcaaaaccccgtctctaataaaaatacaaaaattagccgggtgtggtggcacatgcctgtaatgccagctactcaggaggctgaggcaggaaaattgcttggaggcataggttgcagtgagccaagaccgcgccattgtactccagtctgggaaacaaagccagactttttctcaaaaaaaaaaaaaaaaaaaaaaaaaaagaatattttggcattcaaaaaaaatttcaccttgccccagcagctcagctgactcccacccccatgacacacgtctaaaaagttgtgctgtgagtttctgaaatacattttaaaacagaattcatttaattatgaaaatgcaaacataaaatgaatttgtatctaggttttagtcaagtaaaattagagttaaatcaattaataaatggctaacatgttctacaatatgaaaaccatacccagttgcctcttcttctaattcatcatttttctttcttattcgattcacattatacttcagtgatgatattaactcaaaaagttttcttaattcttcattttcttttttaggcttaaaaaaagtgtttaaaattatttttgtaaaatctggagaccctcttttatctcaaaaatattatttctcataagtggattagtaatacgtatttatgcaggtgtataaagtgcattttataaacctgatgccaataaggtcagatttcaataatagtcacttttcttaaaactgctaaaaatgattcaaattttcatcattatcttttctgaaatttaaactgccaacaatgtttgttacaaatgagggtttttacacacaaaatactaagggttagttaaaaaaaaaaagagtagttatatttacattttagtttttaaagatgctctagaaatattgtttttaacagtttaagatattccaagttctcttaaattacatcttactaagacaaattttagaaaactcttatctagttcccattacatttttcatcctcatctgtcttcaggctgagctaaatactgtcattctaagtattcacccataggtttcagtttttccctttctcttaaccatttctctttaaataaagtttattttttctacaataaacaaaaacaactttcgtctactttttgtggcttttctattatcctgtttctccccttccattggactctatgacacatggtttcattcagaaatcttttttcatcaattattgtgttttttatactgaaatctgatttttaataattccaataaaaaagtccaacggtcatgaaggactttatcctgctttactcagcagagcagtgaccaaatgctccctctgctcctctgaccccacttcctttctaaatgcagtgacctctgttcttcagccctatccttttctggttttttgttttgtttttgttttttgttttgagatggagtctcccactgtcacccaggttggagtgcagtggcatgatctcggctcaccacaacctccacctcctggattcaagcgattctcctgcctcagcctcccaagtagctaggattacaggcatgtgctaccacacccagctaattttttgtattcttagtagagacggggtttcactatgttggtcagactggtcttgaactcctgacctcatgatctgcctgccttggcctcccaaagtgctgggattacgggtgtggccactacgcccggtggctatttagctttttaaattctctcaggactcctaaaatctcaaaactttgacctagattccctaatctacatttccagctctgacctttttcttgaggtctcttccttctagtacacatattatagacaatattctccaccacatgctcatacattgctacttggtgcagattacttttgtagatagtgaatcttgtctattttatgttggttcttattgatgttactttgagtatactgttattttctaatctcaaagggggactatctcactgttacgatactaaccagtatactttgtcctttttttcattctttcttcttttttggaccaatatactttgtccttttctttttttgagatggagtcacactgtgtcatccaggctggagtgcagtggtgccatctcagcttactgcaacttctacctcctgggttcaagtgattctcctgcctctgcctggcaagtagctgggactacaggtgcacaccaccacgcctggctaatttttgtattttcagtagagacagggtttcaccatgttggccaggctgtttttgaactcctgacctcaggtaatccacccctctcagcctcccaaagtgttgggattacagatgtgagccatggaacccagccctctttttctttgataatgaaaactttcccatgagaatcagattatcaattgtttgcctttgttttcttttaaataatttccttttccatagagatatggcatgatgaacatcttgttctaaagttccttttgggggacactcaactatgtcatcgggaagcttcagtaagtagagatctcccttcttcccattcaagattcttcatctcaaaatggtgtctaccaaatgtcttaatccaggtagtcccttgcttagaaattcatgaaataagaaccttctggagaagttagaggctattgattgagatggtttaaagctgccccttattatgtgttttactcccaaggcagacatcaaagcggctaataattctatgcctgatgtctaactcacttctatgggaatctatacaacatgatttatttatgagacagagtctccctctgctacctaggctggagtgcagtggcttgatcactgctcactgcagcctcaatattccaagctcaaacaaccctcctaccacagcctcccaatgtagctgggactacaggcatgcaccaccatgcctcagctaagtgtttaaaaaaatttttttttttttttagagacagagtctcactatattgctctggctggtctcaaactcctgggctcaagcaatcctcctgcctcagccttccaaaaccaggtgtttaaatggggactaacatgaagcacttagaagactacatggaacatagtgagctacataaaatatttgctattagcataataattttattgtatatcttaacaaaattgtgtatttacgcaggtggcatgccaatggaagtagtctcctatagctgcactgaatcattcttaacactgagagttgcagcaaatgggggacataatttataacttacttttctctctgtatgactcattaggcaatgactgtgtatgtactacaatgtaaatagcacctcctggatggaatagtacgtaactgacatgaccagcagagacaggctaaagacactgagctgaaaaccctggactctattgctaagtcaaggctcctgaatccgttccctctgagcaactgttgctgtggtgctgccttcacaagcactctgctgagcactcagattgaggggctgtgctatccttcatcagacaagctgcacccagaactgttcagctgacagactgggagcagtccagaaacacagtaatggctgcatagtgaaaaaaggccaatttatattctttttcatagagagaaaaacataaacacgtgattgaacgcatctcctgtgttagactaattgggttagatttgatatttaattgctaaaaatatatttagaatataaccttactgtgtcaaggtctcaaagaagaaataattggtatggtataaatgattgaattgtatgctacaaacttctaagctaaaatattttcaatgtatgcaaggataggtggcatacacattatatattattcccccattaagcaaatttataatgagagaaaattatcttccataaaaaaataaaagccatgtaaaattaaggactaagtttttcagcacagactagacaacgattgctaacacataaggtcaatgacagaacagtcagagaaagcttcatgaaaacaaaaaaattgtctgccaggtctgaatgaatgaggctagatgaacagaaactgagaaggcagaaagaatagcatgagcaagacaagtgctgaaatctgcccaattaactctgaggataaagtccaatggcagggaaataaaaacccgtgtccacataataacctgtaagtgaatgttcacagcagcatttttcataatagctaaaaagtggaaactaacctaaaggtccatcaactgatgaacgaatggaaaaccagtatagccatggaatagaatatcatttaactataagaagaaataaactacgaatgtgtgctaaaacatgcatgaattctgaaaacattatgctaagtgaaaaagccagtcacaaaggactacatattgtataactctatgtatatgaaatatgcagaacaggcaaacatatggagacaaaagtagacggtggttgcctacaacaggggtaggtggagggacatggaggaaggctgcagtcatgcctaggagatgtggggtcacttttcagggtgacgaaaatgctgtgaacatactaatagacactgagttgtacattttaaatggttgaactgtctgatatgtgaatgacatctcagtgaatctttttaaaatccaaaggcaggatcaagataattttctcaactcttaatttttgatgtacatgctatatcaaatctaaatatttctacagttttacagtatattttaaataaaagataaagaaaatgcctaacttttcaaatagtttgtaaattaacctaaaacatgcacatttcaaagaatagtataatggcctttctgtacaagttaacctagaatctgtgaaacaaatagacacagattctgtgtccattcacaaaagtgaagaaataagacaattttctggaacattccatgaaacattctcctctgatttaatctggcttgcctcatcagagcaatacacaaattacttaaaaatactgtttaacaggaaaaaagtcaattttctatgaggaatgatgtataattctcaacttttccaagggtacatattgtaagagaaaaggtatgcaatggtttttcaaaatggtataatgaaagtcacaatataaaaaaatagtacattataaagatagtaaaatggaaatcattcattataatgaaaataaaaaatcaagcttctgccaaaattagtatcctaaaacacgttatataattcaactagctacagaataactgttgacatgttaaattccatacatatttgacttttcacttgaaataatttcttatttgaggcctgtgtctcatccaaattaatgtgacaacgtgatataccttccagtggagactctaacgtcgttaatttttttacgctgtcagccacttcttgttgaagttgtctcacaaccacctgataaaatatttgttactgattttataaactgccttattaaattatgttaataatgtttaattctaacatatctactttgaaaattatcaccacacatatcaattcaccttcttttaatcacatgtacacatttttatttattactgaattcagtgagggatgcagaatatgttctcttcctgccaaattggtattctcttacttacacaacagattcattccaacattcaatcatctcagaagctcaactcagcctcaaagttcctaacatattcaatcacctgttcaaatccttccaacagattcctatctcagaataaaagtaaaattccaatggcctttgaggccctaggtaaaaaggcctctacctccctctctgacttcaaagctcctacaactccctcctgtaattactccattcccactgtatgtgaagcctgccacccctcagtctgaaaatggagatgtagtgcctaactcgtaaatcacagacagctacaagtatctttgtactgaacaaaattatattccaatgacagtcattgagccttgcaataaaaattatgagctaattattaatataaatattcaaagtaaactataaataccagtgggaaaactaaaccaaatatagttttgctaagttttaccacatttatcctaaattatgattttataacaagtaggtgcctttaaaacattacatggtcataaaaacacgtaatttgacatattttcagatttgttaatatgaataataacaaagctataccaactaaaatacataaaaagctagttaaagcaaggtattacaagacacagcaatacacttcaattcatctggggaatctagaattaagtgtcgaagaaaatcacttaattaaattttaatttgaaaatactcacttcaggtgtaaacatttccatttataactacattatggtcttaacatgtggcaacataaagacattaaaattactatttcagcaatacagaactatctaccttaaaatatgactctgtgcctaataaaatttcataggtgacacaatgtcttttctcaaagtaaatcatctctcacctctatcttttatttcctagaaatgaggcatgtttctaagccgatatagtaaacacatttttcctttttttattaaaacagctttgttgaaatataatttacatactatagaatgtatctgttttaagttaaaagatttttagtacatttactgagttgtgcagccatctctacaatccaactttagagcatttccatcactgtaagattcctcatgcccattagcagtcactaccagcttccagccccagccccttgcaaacatgaatctactttttgtccctatacatttatcttttctggatgcttcatgtaaatggaattatacagtatggtaaacacacttttaatctagatttttatattcaactaagttcaacatgtatccagaaccaaatgtttaaattgtctttctagaagtttgaaaatatttatcttccttgatacttactactccttctgttttctctctctcatactgaaagagactttcttttaaatgatcacattcattcattagcttcttacttttctcttctagcacgaggtctttctttccactctcaataaagcctctttggatattagttactatctctttatgatcctctttctgatgaacgtcatctagttgctgtacaagccacgcattttcacgttggaggtgacatatcctctcttctacacagttccactttccagtggaattattcactttagcttctgcattttgatacatctctttcatttcctgtgtttgctgctgtgtttggcttaggtcgttttgtacagtttctaaagccaatgacttttttctgagactatctcttgtcttacggaacttatcttttaaggcattgaatttaatttgtgtttcagaaagttgttcagtaagaaactcattctcatcttttactttggaaatagcagaactcatttctacttgtacagaaacatctcgtgttctctctaaagcaagttttaggtttctttctgttttcacactttcactgtgtttgcttatagcagcagccagtctagactgataagattcaatgtcagcttccagtcttttcttgctttctttttccttcaacagttcggcattgagccttgtattctcagccttgagataattaagctcttgttgataccggaatgctgtttctgttatcatttcctcattgagttttatatacttttcaagggcagcatttgtttctttaacaattttaatgtccttaagatatttattttctttttccaagttgtcatttttcattgtacatatttcctgtctgagtatagcaatatctgccttcaaaatgcaattttcatccatcagacctttcatttcttcatgattatgaaaatcctaaataaaacaaaagaaagttttagctagtactcaataaaataacatatcatgattacctctgaagttaaagaataacctgcacatccgtaccactaaaaagtttaccataagtggatatccacctggagaaaaagttgaagcaaaactttgaaccttatagagcataaattccagaaagttcagaaatgtatttagagtcaatgaatttataaaagtaaacacacacacacacacaccagagaatttttaagaatatcagaattggaaaagcctttccctgaattacaacaaactcaaaagcataaattaaagcattaacaaatttgactaaattaagatatatcaaaaaattgcatttacactttgatacctaacccatacaccaccctatagtaagaacttttgttcacacatatttggacagataaaatttcccagagttattacagttctgtttcactgataacattctatttcagtttgactcttttaacacttttatagtcagttataagaattacattcactaaatcataaactagacattatactagtcactcctatatacattcattgatgaactcatctagttaccataattttgaaaaagaaatgttaaaaatataagcaagctacaggattttccccaggacttctgactctacttctagttctccaacagatcacagttacttctgtggtgtaaatacatcaatacgaaagaaaacttttatttcaaaatgccaatagtaaataagataaaatttatagagctcttcttagaatatcatgagattatttgcgattgcaataatttctgcttcctctttataatattaggtgcagtaatcaatatgaaataggggaaagtacaaggaaaaattttacctggaacaaaatttttatcaataggttatcactaagtataaattatggcatattattgttttcaaaagctctttgtaataaaataatatcctatgtggatgccaagatttataataaatattaataattgtacctgtaagtgtcatcattcatttttaaaaatgagataacatttatggttttagacctaaacaatatatattaaatcaagtggatattataagtaacagtgataagataaagtttaaaatatagaatttttaccaaagattgatttacccgatttggagtatttcttgcagtctttgatttcatctctagtgactgaacagttggttcaagttgttttgcttcaacttctttcttatattgtttctctttcctttctaattcttctctattttttttgtacagcatattaacatttgttttttcttcattttcttgttttaaggtgcatctgcagataaagacatttgtcttaaaattcattttgttaaaaaataaggagttcatcctgttatctacctctgcagatgttgtttattatcctaataaaatttctatgttctggattatttttcctttgcagttctcagatatttaatttctcacttcaacatcttcaaatgaatgcatatacttgaaaagtagtaaggaaagaatattctgctaaagtttttgttactagtcactctaatatatattataaaaaaggataccagagataattcagtaaagttacaggttcaaaattacctttttaaatcacacagtcataattactccctaattagaaaagatcatttacaatcaactaaatttttaaagttactatttattgacaagcgtataagttcactagaaataaattttcatctttatgaaatattgcaggtgtttctccaaatgatttacagagtgagatgacaccttcagatgtctctcacacaaactatatctgcagatgactgtcatccaaaactaggctgaaaagtctaacatctgtttccccacactttttatatttctttcttaatactttcaattcaccttcttattacatatattttatatattcattaacctattgttcattatgtgtaatatataattaatgcatgttaattatatattaataagtgtgtgtatgtttacaccagttatgttttcctgtgaaatctagtcccagaagtggagttgttgagttaaagggatgtcaggctatttgaaattttgatacacagcactaagttacccttcagaaataatttactaatttcctataccaacagtgtatgagaatgcctttttcctcacatttgccaacactaataattactttttaaatatcagcatgactttacaaaatatatcttattttatgttaatttgcttttttctgaataccaggcagggctaaatacccctggtaaaaatataaaacttgttaatcataaggaatattagtccaattttcaattagtttatagcacaatgacaattatctcctgtgaaatactgctataggcggccaggcacggtggctcgctcctgtaaacccagcactttgggaggccgaggtgggcagaacacgtgaagtcaggagttcgagacgagcttggctaacatggtgaaatcctatttttactaaaaatacaaaaaattagccgggcatggtggcacatgcctgtaatcccagctactagggagactgagtcagaagaatcgcttgaacccaggaggcagaggctgcagtgagctgagatcacaccattgaactccagcttgggcagcaagagagaaactccatctcaaaaaaacaaaaacaaacaaaaaaaacccaaaaccaaacaaacaaacaaaaaaacactgctataggcttacctatcatgctcttccttcagcttcttgggaaattgctgaggatacgttttcccaatctttctttgttgggttaatctgccagcagcagcagaagatgtactatcacatatattttctgaaagttgtattttttcacttttgtttgtattatttccttctttgacctttaataaaagatgaataataattgttattattttattcaataaaaagaactttttccctgatttttattacttgattcaggttaactatcaccactttaatgataaaagtattttgtgcttactttaattttatcattatacataattattataattataagatactcttattttatcatcgaaatttttgtcaaatctgctcatttctgtttgagggaatagaagaattttccaaaatttcaaaaagggctcttctccattttgtgcttttattcccatccactctttgctatctggtataaatttttatgctatctggctggcagaaacagagaaataaaaagacacaggcataatatatgtcttctgtctttactacctggattttacatgaaatagccagattaagaagatgtgaccttgtaggccttcaggaacagtaaagaagttttcccttttctgtactgagctactcttttccccactgccttttatctctcttttttttttttttgaatcctgtgatatcaaaaaagtaaaggttctctttgaattatgggaaccaacgtttgccacaacaaaagaagcagagtgaaactgctgagtttctagtgcagaattctggaaaatgagatgcttcccagatttcacattcaattaccacaaaagtttataggtggaaaacatatggtacagttacctactttaaccccattatctactgataatgggagtcaaaccaaccaagacatattaaatgtttcatccagagctcttgaggtggcattcactagcatttcatggcaccatataacatgatacaattccatattgctgaattacataaattaccagataaatttatcaaattagatatattaaaagtctaacttgagcaaagcaatttaatgcctcagagggtggaaaaaggcctcatctgcttttactttgaaagaagaaaatctctagatttttgtctatctttagaacacaatgtacagaactcaactttctactaaagagtcaaaggctaaatttttggctaagaaattatgcttcttatatgataaaaatcatacatgccaaaacttaccatactttattaaacaacataacgtaaggtctgattcaacagaaatattgcagagtggtgattttttaaaatatgtgtaagtatatgtttgttttcaaaaatattggaaataaccatgatgggactgtaagttcaaacagtttgagctaagcagataaacttgcatgcatgaaaacacattaaacagactcatttggctgggaatattcgttgcaactctcaaggctagacgtgtttttgtggcttgtctcagtcattgcttccctcccattgtattcccattctatcattaaataaatgtaaattatctctaaatgaatacaagaaaaaagaatctagaatctagagcttgtttctttagcaatttctttatgttgatctggttcagaaggtcacatggtatgtggcttaattagtttcccagctcatacgccacttggaagactgatagtgagacataggttgattaatgaacaaacattatgagaacattctccagaaccattatttagatagcagaactaatctactttgacacataattacacatttagataaccccactgtaactgtacacatgagattttcttgaatagaaaatttgactaaatcaaataattgataaagaggaaaaagaagcagcaagtgaacctctgtctttttgaagttggacttgcttttctccaaagccaggaactcaacttgtaacatgcctacctcattctttttttaattattattatactttaagttctggtacatgtgcacaacatgcaggtttgttacatatctattcatgtgccatgttggtgaccttggaatatcttcccataagtcttctagctatatttttgatgttctctcactatgtggtaaagaataactcacattttataattcaagattcatgcttctgtagttgttagcactgggattgccatatagtggctgctggaataaacgctgtattggttttctgtttttataagtatctgtagcagcagaaatactgtggctttctatctgaatcatatgcttcatttctttggggtgggtaaacaacaaatcaaaaagactttctggatctctagactgaggccaatgcctaatgtccaatttccaattagtggtatctgggtttacattttttgccatttgcatgtcaaactcttaatcatctttcatttcaatcataattactgggttccttaattttttggtttcagtatcattacaaaaattttcatcatctgtgttagaaacaagctatgtgtctggtttgctatcatttttatagtctgatttattttcatttaaatgaagcttagaagatgactggtaactgtatttcagggacctggagtatgaatggaataaaaagacatttgacatgggcttcctctgttcaggcgctgcctggaatgccacagagttagaccctccagatgcatcttcctcctcacaatcagggacctgattcatcagattagagggcactccttttttgttcgtccctctttagagttactatgtaggagctcttcctcagggcaagcagtaattctggagttttcaaaactttcaccaatattcagcttgaacttgtttgtaatgaattttaaagaaagtcgtgaatatacagacagattattccctttatcacaattcttacccagttctggttcttgagacttttttttttttttggcaggtgcaaaatggaaaacaaatttgcttgttttgtttctcagatgccttttctgtcagagtgcatgttttaaaattagctttaatcaagtataaacaaaaatactagaaaataattaaaatttaactgtgaaacttaatctatgtgttgccactcttaaattatgggattgtaactaaaaagtgaaaaataatttgccttggcttaacataggacagaaatatgaactggcaagctgaacgcttagcatttgtttggattaaacttaatgcattatgtgtaaaatctaccagaaatgaattcaaagctgataggtagtattataaaatcttcctctcttacaaagattttacctcagcataccagaaaaagtgagcccctacagtacgtgtatatttctgaagattaactacagactaggcaaacactgaattattaagagccaaactgaacaccaataagaaagggaagcaaaattttaaattctaattcaaataatatactatgatagtgttatgtatctagatggattatctgcttatatccacttctaatatattttaagttccactagtgatagtggatggattttttaaattttagtaacatttactatgtatttatgtcaaaataaagttattgtttgtaccctgacaccaaaggtcccattccacaaggtaggattctcttaataggcaactgggttgacttttatgaccccactcactccctgaacacagacacagaagtcaaatggtgaccacaaaacagaataaatctttaacctcggcactggtgaccagcaatataaaactgcaacatttgaaccattggcaatgatgactcctttaacactagtttaactcagtggccatcattgttaaattgttcacaatttctattccttaataatatgacccaatatttcatgttaccttctgtattatgagtaaggttataacaataaaagagcaagataattctgaaaatgtcttgcctcaattccaagggtaaagacagctatgagttactagagatagtaagaattaccagaataactaatagttactagagatagtaagaatatcttaagtttcataactggttaagatgttttaaaaattaaatataaaattatgatctatcggattctaaaggtatagtctaaaaggtcatgtcatttggactatgctttgttactgaagcaaaaaaacaaaacccaatattaaacaagaaacttgaattttcatatacctgtggttgcttcttttcacttctttcatgcctttcttgctcttcctctgaagccactggtaaggcttgttctgttgacaaattcattggtttagttcaaatgaactaagaacagttagataaagactataatctatataaaaataaatagagaataacatttctttgtattttatattttgagagtttcaatgaagcttaatgtttactgaaatatttagttctttaagaaatacttctaatcatccaaaatttcaacaaaccacttggggagacattagatatcaccaggttcaagccatatgaaatctcagggtcactcacaaattgttccacccaacataaatcaacaaaactgttagaaacaaaacaaaattttgaaatacagtcaaaatatacaatgtaacactttactatacttcataacagtatctttttaacaagacactaattgagttggcagttactaataatttgcaaaattattgttgtttataccttaattagtgtgcaccccattttttacatcgcaaatgttttcccctactattctgaaaaatttattttcatcttttaagactcagaaagtaggctgggcataatagctcacatctgtaatcccagcactttggaaggccaaaatgggggaactgctcaaggccaggagtttaagaccagcctgggaaccatagataaccttgactctacaaaaaattggacaggtatggtgatatgtgcttgtagtcccagctactcaagaagcttaggtgagaagatccctcgagcccaggagtttgaggttgcagtgagtctcgatcacaccattgcactccaccctgggtaatagagtaagaacttgtctccaacaacagaaaaagaaaaaaaaaggctcagaatgctgtgtgaagtcttccttgattctagctgtctttctccacacacacaggtgtctgcttcattggagttccttagtactttgtcaacttttccagcgtcactttaccacctgaactgcacatcatgtctttacatgttgatcccctttgctgttagactgtagaggacaatcttttgaatcatctttgtataaacagtcttaattttgctaaataattacttattgagttcctgctaagtgttaggcactggggtataaggaaggaaaataaaagctgtcagggatggctttcctaaagatcatgcatgagctgagacttagagagtaaggttagccagattaagtgaggcagagggcaggaaagggtgagcacatgccaggcagcaacaagagagggagagaagcctccaagagagtatgtatttctctgcaaaagaggaatggtgagggggccattaccagcagctcagtaattccagagaaaaaggcagatggggaaagggctacagatggagatttgggcagaaatcagtttccttttcttttctttttttgggacaaggtcttactctgtctcccagactggagtgcagtggcatgatcttggctcactgcaacccggcctcccaggttcaagtaattctcctgcctcagcctcccaagtagctgagattacaggcatgtgccattaccacctgctaatttttgtattctattagagatggggtttcaccttgttggccaggctggtcttgaactcctgacctcaaatgatccacctgcctcagcgtcccaaagtgctgggattatagacacgagccaccatgcccaacccagaaatcagtttctgaaatccttatataaaactttaagatgcttggacataggtattcaggagtggttcacagatctatttgcattagagataattaactctaattattgtgaggagcataaaattctgaggcatataaatcaatgaacaaagataaaatataaggcagtgttgcaaagatgatgcaggcctgaggagatgttttcagaaatatttaggacataagtatcagtggccattgtaagcatgaatttttattgaatgaataaatgtatatatctgggtccctggagaaatacactctgctcattactttacaaattttatcaaatgagaagtagaataatatacataaactgtttcagttacttgtatttactttacactttttctgtttcagttttactgtgccaaggaaatgcatttgggttttgtggtggttgttgctgttgctgttgttgttgttgttgttgttgttgttgttgttgagatggagtttcactcttgctgcccaggctgaagtgcagtggtgcaatctcagctcaccgcaactgctgcctcccaggttcaagtgattctcctgcctcagcctcccgagtagctggaattacaggtatgtgccaccatgcccagctaattttgtgtttttagtagagatgtgtttctccatgttggtcaggctggtctcaaactcccaacctcaggttatctgcccgcctcagcctcccaaagtgctgggattacaggcacgagccaccgcgcccagccacatatggggattttgttttaaaagttctgtttcctggatctaccaagctcatgagaaaatagaagcaaacaagtcatttgcataggtaagaaactttggatttatactttgtcatcactactctagaagattatcatcatgttttgtaaaataaaatgttaattctagacataaggggaaagagaaattaaaactataggggtgaaaaaatattgcataatttattactgttgacctgaccatatgactgattaagggcactgaatttaacttgtatgtgaagtagaccccatattagctgcagttaatcaatagaccaggtattctagcagaattaaatttgatgctcctgtgttatctttaaatgatacagctcttctgaaaacccatactcatagtgcatgattatccattaagacaaggtgatggaatgtgtgaatacagctcaggagacaccacaaggcaaatgctcaatggttcccattaatattggggaaatcaacattataatacagaaaaccataggcattatttaatatttggttttggaaggtatttttagtgacactgcatagagttgtacctaataattgcaaaattacagatgtaaaaataaaacaaaggcacattgtgtttgagtaggaaatctgtagacgtctagctggttttctattccaggcccaaaattctaaatataatcatggtacccgcacacaaatttatgttaaataccaacttcaatgaaattactctttctcctcattctctttgttatttatatgttgctttccttaagggaagaatacaaatgccttgctaagaagcattttgtttggttgtaggctgcataaagggagtaaacacaaagtacatttgaccacagaatgactttttaaaagccagaactatggtagcatgaagccaactgaggtaatctagaataaaattttctatgtttgtttcccttctttgctctctttctactctaataactgcgattcacagaggtaatgaagagtataattccctgataaaaacacagctccaagattaatcctttctttaactatgaagttcgtgtgtccaaagtcttgtagttgctgatttttgatcacgaatggtgatacagatatttatcatcaactcacaacttcccaaatctttgaaaagtcttactattgatggttcaactagtagaaacataatctaaaatatctgaaaataaagtttttattagaatgtaaatagtaatacaaattgtaataaggtgtaaaagttctttcttcactgaagcaggaccatgatgtcctctaccccacaaacacactactccctcatggtctaatgtatcttaaaagtcctgtaattgctattaactcagacaagtttacttaacttgttctaagcttctgttatttactacaatttactttatcactcaacaatctctattatatatgttgttttccatgagaaatttttttattaataattaggattcttcagggataagaaaatatttgaataactaagtttgtgcataaacacattaaggtcaaatacccatgacaatattgtgtgtttctctgtactagagacaaaaacttcaaaaaaatttttaatgaatatacattaaaaactgctttcattaaactgagatgatcttccctcaatgcatgaataccttcagaattcacatagaccaaagaattgtataaaatataatagccttaaaaatcttatttgtacctggcacagtggctcctgcctgtaatcccagcatactggcaagctgaggcaggcagatcacctgagatcaggagtttgagagcagcctggccaacatggtgaaaccccatctctactaaaaatagagaatttagcagggtatggtagcacatgcaggtagtatcagctactcgagggcctgaggcaggagaattgcttgaacccgagaggcagaggtggtaatgagtcaagaccgagccactgcactgcagccttggtgacagagcaagactctgtctcaaaaacacaaacaaacaaacaaaacacctaattgttcccacataagtctatattcacacaagatctgaagagtacacaacaccgtgagacaggacagacataaattttaaaagttatattcccagtttctgtaaaaataaaacggttgaatttaagcttttaagacaagtcaaggaaaagagcaaaaaatgcaaaagtgaaacttgaaaggtcattttcccatcaagggctcatgatccactggacattcacaaactatattgttcaaaacattagttctgaattttgatctgagtatccctggagttgcagtttcattcaaagatgtccaagaggtcaaataagacaatatcatttgctattttcagttttcttttctgagaacagcacaacaaacttcttcagagaaatgaattgtcctaacttcataggctaaaggctcatgagtcacagttctaagggcatttataaaatatggtggtgcatgcttgtattctgaacttttcaactttaaactctcatatagtaaatattaatagatacaaactgattaaagaaaagcccacttaatctgacattatttttatttttctttctttcttcatttatcagcaacaggagagtctaactaaatgtggtaaagtggtataagggaatacaatgaaaagtgtaaaatgaattaaaccagagataatcatatcaatgtggatacatctggaaaatataatacaaaatacaccaaagaaagtggcagaaaggtatgtaaagtgtataaccactcacataccattttgggacacaaataaaaaattctgcatattatttctgagcatcacaatatagttaaagatttcaaaagggcattgaaatgaaaaacaaccaacttatgatgtcggtagcctctatgcaatcatgttttaaaaaccttaacaccaaaaagtctcaaaatcaccattttaaaagactgtgtctaccagttataaatgaatcattactttcctcatttttaatagtcaaagatgccacaaacacacacatacacacagctatatatacacctacacacacagtcttgctcattagaacatctgattggcttcagatcatcagtgtaataacactagcagcaagcctctaaagttaaaacagaatctgacatgttaataagtaaagctttcctctaggtaaagttcagaactccaagtagcacttaactcattggaaatatcttagagtctcaaaattcactgctttgaatccctgacaggtataaaaattttatactgaaaacttcatgctattcaaaacattaaaagagaaacatctgagttaaagcttacatttttaaaatcttttttatgcttctaaatttatttttattcaaatatggataccaacaataacatttatgtcaatgccttccattcaattttgaacaaatagaattaggaataagaataatgtgagtacttccaatcattgaatgtacttatttccagtattccattaaatgtacctgctctcaatgtctgtacattctttctttgtactgctcctttcacagcaggatcttctacttcagtgctaggctgaatgggttttaaaagaaaatgattcataaatcatatatattttatacaacatggagttagtgattcaaaaatatacataattaattaccttcaaggaaggatgttttgcaggaggccctacaaagcaaaggggatatgtcatcaattatatgtaagtatgacagggccaaccaaacattcatgcagtggtactatcgagctgaattctcatgcctggctataaaaataattacttaaggttttgagggttcttcttggcatcttttcattgcctaggacggcaacatgacagaaacataatgaggaaaataggaatataggattcctaaaatgcacagtttacatttcagtagtgagattatgtttcaaatgcctatacctaaaatagaaaagcatggatatcaccgtgaacatgtggactgatgaggagaaaagggaccattaaacagaggagcaaatcaaacctgagggaatcgacgtcaaagctgatggtgaatgtacagagtattttaactcaacacagcagaggcattgctgccagcatgccacaaacaaattccccttgtcttgtcactgaggaaatacacagttgggatgacagttcaggtgaatgtgtgattcacctctcatcaaagaaagtgttctacattgatcagctagtatacacacttatgaaatgacagctaatcaaactactcatttttcccatgatcacatgggctactgcagcacctacatttctcctatcccctcatttggccttgagttagagctccttgatccactcatgcaaggatcacataaaataaaccatgtcgaataagcttccgatatcaaaatatttatcaaaaaagaaaacactgaattaccacagacttgctggatatgaatacatatttatatttcaaaatcagtgcagtatttattgaaaaagagaattttggtattcacagaatgaattttgtaatatcaaaaaaaattagccaaagcatctatatgcaacttaatcacatcttattcactcatgtcagtgaaacttctctctctgaggcctgacagttatcaagtgaaatgagctgctgtggtttaccccaactctagcactccctcctgcctccagtactctccacagcaataacctcttttgtgagactgggcatatgctgaagcaactggaagtgagttgtctcaagtttacttggcttcaactcccaagaccccagcaaatgtctttctttcctccctccgtgtcctttcacaatccctcttcctttgaaaaagtgatttttagaactgtcatcctgatgcttcccttcctaactgctttttatggataattgtgaccacttttttcatctgtattcagcagtagtatacacctgtaatctctctgttttcatctcattctccttcccctgtggctagaatcatgctcagaaataaaaggaaattaatgctttccctggattctgttattttttaaattgctctccaatggttctttttccagagttctctaaaggaaggctattcccttgctattcagagctgtgtccaaggaccagcaccaaaaatcacctgagtactcatgagaaatgcagactcccatacctgctgaatcagaatgtgcaccttccagaagctcttcaactcattcatgacaatttgaatgccctgttctacactgatgtgcttccatattggtttcccctaattgcccttttggcctagcctcaatttcttccctattatgtccctcaatttaatactacattataagccataatgtttctaatgaacttttaatcaggcaataacttcttgaattaatttcttctccataaatcacccaacactattcaattatgttaatttggcctatatgatactatcctatgaggttacaacattttctataaaaacaaattatagccatacatggctgaccatctttggtgatgttcatctatggtagataaaacacaggtctgtgtggtgaggtgcctcaatccttaatgcctccccagtagcgaggatgacagcaagagaaggaaaatgttactgtaattctctgacacattttggtactggaagctcactttatcttctttcctgtttctaacaccatgttcttccttcttctacagatcaatttgcctttactatcctctcttacttacctctgcatatgcttttttatttattccatgtacaatccgctctcctcattctttctttctctttattcatttcctcttccctctctcctgacttgcctcaggtcttagagtatcttaaaatggaactcacaattcagctcctttagtggtactcccaatagaatcaactgctgacccttggttagagacacaacttatcaccatttcacttctcctttacttattatacagttaataggacactttctttagctattacactctattagtgctcatattttcaaagaaacattccatcaaatgactttttttgttttgttttttctgagacggagtctcgctctgtcgcccagggtggaatgcagtggtggtatctccgctcactgcaagctccgcctcccgggttcaagccattctcctgcctcagcctcctgagtagctgggactacaggcgcccacaacaccacctggctagttttttgtatttttagtagagatggggtttcaccatgttatccaggatggtctggatctcctgacctcgtgatccgcccgcctcggcctcccaaagtgctgggattacaggcgtgagccaccgcacccggcctccatcaaaagactttttaaataaaatacggttctcaccttctccttgtccattgactattctgtttcctttttcatgcgaagatccaggtaaaggctctgacactttctcggggacacactgctaaggtaatatcaagaattagtttccattttaaaattataatgagttgcatcaagagtttcttatcaatctctttttatgaaactgggtctcactctgtcaacccagggctagaatgcaggggcctgattatggctcactgttgtctcaaactcctgacctcaagcaatcttcccacctcaacttcctgaatagctggaactacaggtgtgtcccttcatgccatgctaatgtttttattgttatctttgcagagacaaggcctcattatactgcccaggctggtctcaaactcctgagctcaagtaaatcttccacttctgccccccaaagtgttgagataagcagtgtgcaccaccacacccagccctaatcaatttctttaaatcaatctcaatgttgcccaggcatggtggctcacacctgtaatctcagccctttgcaaggccaaggtgggtggattgcttgagttcaggagtttgagaccagcctgggcaacataatgagaacacatctctactcaaaaaataccaaaaggagtcaggcatgatggtgtgcgcctgtagtcccagctgcttgggaagctgatgtgggaggatcacttgagcctgagaggtggatactgcagtgagccaagatcatgccactacactgcagcatgggcaacagagcaagaccctgactccccaaaaatttcaatttaaaatatgagaatgaagagagatacaaacaaaaaacaagcctaattggtcaatgaaatatgagcttaagccaagaaagaaaagagacaacatgaagtacaataaagtacatggggaaatagatctataacagagccttttgctctttcatatccctgataatactaattaatatttatgctacaattagttttttgtaagtacttctgtgatatagcttattactataagacattcaattagctaaatatggtcatcgaccactacctgaaagaacattattataacacagagagaaaactagaactttcaatcaactttccacccagaaaaaaattggtcaccagaattctaaagagtaacgtatggcagacacatgaaaaaatgctcatcatcactggccatcagagaaatgcaaatcaaaaccacaatgagataccatctcacaccagttacaatgacgatcattaaaaagtcaggaacccacaggtgctggagaggatgtggagaaataggagtacttttacactgttggtgggactgtaaactagttcatcctttgaggaagacagtatggtgattcctcaaggatctagaactagaaataccatttgacccagccatcccattactgggtatatacccaaaggattataagtcatgctgctataaagacacatgcacacgtatgtttattgcggcactatttacaatagcaaagacttggaaccaacccaaatgtccatcaatgatagactggattaagacaatgtggcacatatacaccatggaatactatgcagccataaaaaaggatgagttcatgtcctttgtagggacatggatgaagctggaaaccatcattctgagcaaactatcgcaaggacaaaaaaccaaacactgcatgttctcactcataggtggaaattgaacaatgagaacacttggacacaggatggggaacatcacacactggggcctgtcgtggggcggacaaggggggagggatagcattaggagatatacctaatgtaaatgatgagttaatgggtgcagcacaccaacatggcacgtgtatacacatgtaacaaacccacacattgtgcacatgtaccctagaacttacagtataagaataataaagagtaatgtatggcttgaaaacgtatatttaatagaacatgagttagagctaataaaaagcttaagaaatgttaatctaaaatctcaatgttaagattccagttgaatgatactagaaaatatattgtaaccctatttgctactgatgacctatttctattttatttcctttttaattatggcataatttctcaacataacatatcaaaacttatacacccttaaatattaaaaaatacaatgtaagcaatattttaaatacaatatttaattattagatacattaggtttattatattacttataacattccattatataaaaattcatttgtctatttattcagattaaacaactattaaggctgaatgtcttatgcctgtaacccagcactttgagaggctgaggcaggcagaacacttgagcccaacagttaaagaccagcctgggcaacaaggcaaaaccctgtctctacaaaactcagctgagcatggtgacacaggtctatggtgacatagctctattgtttaaactacttggatggctgaggtgtgaggatcacctgagcccaggaaatggagattggagtgagccaagatctcaccagtgccctccagcctgggggacagagtgaaaccccatctcaaaaaacaacaactaaaatgcttcttacatggaagactgtattctaggtactccaggatacacacaaatatgtttactgacctccagtagcttacggtatgcaggagcttccaatgattatttaaacaactaaatagaaaaccttctgaaattcaaaatttcagaatatgatatgaggactttgagtggctattttattttttaagatgtagtcttgctctgtcacccaggctggagtgcaatggtgcgatcttggctcactgcaacctccgcctcccgggttcaagcgattctcccaccttggcctcctgagcagctggggttacaggcatgcaccatcacgcctggttaatttttctgcttttgttttgttttgttttgttttggttttggttttttttagagacagggtttcaccacgttggccaggctgatcttgaactcctgacctcaggtgatctaccgacctcggcctccaaaactgctgggattacaggtgagtctccacacctggtgaagtaaatattttaaataaactacaatgacaaaattatgaggataaagtcttaccatccattggtattaagagtctctgcttctagaactggttatttgcagcaaaatacatgttattcaattagatgaagtgccttatataaactcttcatggacaactcataaaccacacaaaaattcctttgcaatacacattttgagaacataaatttaaatttctatatttccacaatttatatttttaaatcagatacgatgttgcccaggctgttctcaaactcctgggttcaagcaatcttcctgcctcaaattcccaagtagcagggactacaggtgtacaccaccacactcagttatttttctacaatttttatttttttttgtctcactacagaaccaataatataagtagaaaaacaatctctcgtaaaaacaatatgataccaaaataataagtttccaagaacaaaagctatatgctatgtgctgaatattcttgccactaaaaatcaccaggaggatcccatgattactgcaaataatttgatccactgaagatttatacaggcataaatattaagaaagtcacactcgtatgatttaaaagtcaaagtattagtatttatccaaataaaccttaagcaaatttcatatttcctctattggagaaagcatttcctaatgtgattttcctgtcactactaattttccagttcattttttttcagctcccaccctgtcacagtacttatcaatctttgttagttaccaaagttaaacacattttttgaatcaactagccatatgtatgtttttctctgaccaactttccattaccaccataaaacaatgataggtaaaccactgctaaatttgaaaagtaaatactatgcaaaagtacattcagagtgagaaaattaattttacaagagaccactttaccttagtagcaacattcaagtctttgtcatccgatgcaggcaatgaatccacacgcagttcatggaaaatgcttgagagcaaaaacacacaacgaaaatgagcaagttgatttctttacaatttttttaactgccagtttatatccagcttccccctcaaaaaaggaaaccataatctagggaaaggtcagcaatctatatattaaatagtgattcttgatataattaaaatatgtcctcttctaaaaatagattttagttacctatttctgcctccacttgtctaaatctataaaatattcaatgaaaactaaccttgagctttataacaaatagtgacagtcaataaattggcagagcctgacaatgatttgccctcacaaattatctgtcctgaagctgaacttaaaattcaattaatggatgacataaattttgttacctaaactggaagaaaactaacaacctaaaacaaggtagaaagatccactgtctcttttccatgatctgtctctggataaaagactaatctgcatcacttcaatatggcagtcttgattcctcagcatggaacccacttaggaaggtcctattgctttcctttgccctaaatcagtacaggaaagcccctacaatatttgaaatgtatgaaagctaaatgtacagaagtcaaataacaaaggtgtatgttcttattgagaatacttttcccagaaagattgaaatattaacaattataaaatcccattattttcaccctataggtcctaccttattcaggtccacataaactagcaagcccttaaaacttttcataggcactcagacacccaaggagagagactgtcagaaaaaaacagagtcctggtaggtgtacctctatttccctaagtactctctaagtatctgtcttcctatgggctcccacttccagattccacttctgcagggctccacagaagtctccaatctttaaatcttcagtctatgaaagcacagattcctgaaaggatggcctcaaatgaccaggactaggagctctctatatccctgctcctgaaaaacaagctaactggagtctccatcacctgcccccagctagacacactaccaactacccaactgaactccatgactgatttgccagccaatcatgcccctgaaccagcccacatggacatgggaaggacatcagtgaatcgggaaaagaggcagaggtgaggagacacctgtactgggccacagatctatgtagttcagcaatctccagccccttagtactccaggggctctaagccacccctttctaagtcaggatggaagtagatgacaccacatttctatctgctgcagacgctcctcccagtgtctcaaaatgttttagcatctttcagtaaaaatcttcaagtttgtcagtccttgatttaaaaaaaagcagcaaactttttagagctcccttgaaccttctattttaatgtgccttcgtagataattcccaacatcttgtgtccttcatttttataatttatctttatcaaacttgtcataaaccccaatattttgatctcttatagaagagtctgtactcctatccaatccagtgttgtttatcttcaaacttggacttcccctgctcattccattcttatctacttccattgggttccccagctaattccattctcattctacccacagactcactcccgtttgtattattaaaacacacgccaataggatataaaaagaagcaagagtactgggctttaacatgagttcaaatctcatttctgccaattcctatgtctaaaaaaaagcatcctaaactctttgagcctcacattctctatctagagaatcatttgaccagaatgttcaacacaggtaaaaatactagaaggtattttaattcattccaagattccttaaaattctgtaattctatgtcctcttgattctgtctatagaaaaacttagaatacatagccagcagagtttgaaaaaataatagaacaaaagaaataccaagaaaagcagagaagaaagttttaaaaaatgaaggcaagattatagaaaagtcacggaaaaagcaacaagactaaaaaatgtattatggaagtaagcagaaatacttgcctaaatggaaaaccaaactgggaagtcaaataatttgtctctaagacttgcctaaacttgcttttgtaaaacttacacccctatggcaaagctaagtaagatctgccctagagcctttgatggtaaaaataagatactggttaccactgaaattgtcaaatttattaggacaaactcttggactaaccacattctaatgataaacttaaatgagagttcaaggtatttaaactctcattaatttagacattaatcaaattaatcaatctgactaatctgattcagacctataccttgatccaagggctgcacagatatctgtcaatctatgctgaggagcaagagacaggatttggaaggcaggcaggctgatggtcaaactgtaggccagctactttgttaactatgggatcatgaggcaattaatcagctctaatccatagttgtttatttaataaacagtaggttataggaacacagatgttgtgatggctttatgagatgataaacgcatagaacatattaggatgtctagcccagaatacaacactcaacagatattcgtttcttccatctatattttcttagttaacataattttttaaatctataaaatcctacctgactgcagattcatcagaacttccaacatctattaaagaaaaaggtaaaatgcattttaaatcaataacaaatgtacagaatattaaaagcataagaatgcacagtgatgcatccctctaatccaaactacttgggaggctgaggcaggaggatcacttgaggagcccagaagtttgagaccagcttgggaaacatagtaagactctaccttcataaaaaaattgtgcacacttgtatgtatgctttagatcctgttttttgttgttgttgtttttgttttgttttggtttggttttttaaagcataagactgatgctttgttacaaagcattcctttgagagcatgcctgggaccttattagaattaacattcgttatacatattggtaggtaattaatgcagtaagaactcttccctttgtatttattagatgcaaagaagaataaatttattaaaatttggtatctacaagtgaactgcagtatgcaagtcatcttagccaaaccctatgaggttgagtaaaaatggtattgttagcagaacaggtgtgatgagtcaccagtgtcaaagagcatgatttctggaccaaaatatgaggcgccattaaaacagagtacacagtagtaccccttatccactatacgtgcagaaagacatacttgacacatttttctctactgtcacaccacagcaacaatcatcaacaaagaaggcttctgtgaccaaatgtgtggagggtttttccccaccaacaagcaagcaatcattcctgctgatgacacaattcaattctcacaccttatctgctggtaacatcagattcaatttaatttataaattaaactttagcatagatatgtatgtatagggaaaaacagtttgtgattcagtactattcatggtttcatgcatccacttgggggtcttggaatgtatctcccacagttaagggggagctactgcacttattttgttataacacaacacagcctctctagctcttcagttcaaactgctcagtttagaataaaacaccctaacaccagatgtcagcaaaacataggaatccgaccagaaacaggaatccttgcaaagactttccagccgctagtggaaaagagctcaaaagagatcaatgtattactctggctactactctttggggaaggtgctgggtggtttacttagttgtagctatttgctctgccctacatatagcaaggcccaaattcacctgccattttacctcccacagaaaaaccactggaaagatcactcctttaagagcttatacgctaggaaccacacctcacattcagagagaagctgaagaaacaccagggaggtgtggcaggctgctggacagtactatatgatgtgaaaaatatatagaaagaaaaccatcaatgcccttttactaccagaatgttccagtgcttgcccttctccctagtaggggaaaaaaattctttttcacctcacagaaagcaaaactctcttgctatccctcatgacagaatctagttgtaggtgagtcacatcatcataatacaggctgttgtcaacctcatccctcaaaggaagaggatcagtgaggaacctatgtacttacctatagcattcactgtctggtcttatttccaaccgaaggtaagtatgaaagactttgtgattccagttttataaagtacaaccccttgcacttgtccccttccattgctagagaatctatctggacccacctcacagagcaagatgctccagtttgtgctgtgtggtacagcatggtgtccttttcctcaaccctttctattatgtgcacatatctatacaaatcatgttttctaagtatgtaaagcatatgtcatcagaatatatcattctttacaatgataaagaagcaaaagaaaaacaaaaggacaaagaacatcttaaatgactacattcaactgccatggagctttaattttttaactattcaaaaagatatccactgtattattccaactatgtgactcttctgaaaaaagtaaaactatgaagacagagtaaacatcaatggttgccacgagttactagggagaaagggaaagatgaacaggcatagcacagagaatttttagggctgtgaaactgttctgtcgataatattacagtaatagatacatgtcatgtcattatacacttgtccaaattcacagaacgtacagcatcaagagtgaagcctgatgtaaactatgaactttgaatgattataatgtgtcaatgtaagttcatcagttgtaacaaatgtaccactctctggtggaaaatagtaataatgggggaggctatgcatgtgtgggaggcatgggatatatgagaaatctctgtaccttcctctcaattttgctgtgaacctaaaactgctctaagaaataaggttattgatttaaaaaaagatattcagctgggctcagtggctcatgcctgtcatctcagcactttgggaggcaaagatgggtggatcacctgaggtcaggagttcaagaccggcctggccaacatggcaaaacctcgtctctaataaaaatacaaaaattagctgggcatggtggctggcacctgtaatttcagctactcaggaggctgaggcaggagaatcgcttgagcctagaaggtggaggttgcagttaactgagatcgcaccactgcactgcagcctgggagacagagtgagactccatctcaaaaaacaaaaagatattcactgtctatgcatcccaggatctccagaacaattacaataaataaataaataaataaataaataaataaatggctgggggcagtggctcatgcctgtaatcccagcactttgagaggccgaggtaggtggatcacctgaggtcaggagttcgagaccagcctgactaacatggtgaaaccccatctctactaaatacaaaaaattagccaggcatgattgtgcatgcctgtagttccaggtacctaggaggctgaggcaggagaatcatttgaaactgggaggtggaggttgcaatgagccaagattatgtcattgtactgcagcctgggcaacaagagcaaaactccgtctcaaaaaaataagtaaataaaataaaaaataaagatattcactgaacctgttactatgatatatttaagcaagacacggtgaccctaaaaattagagatcattgaagaccaaagtaacaacatgtggtcattacttctcaaattgaactatataaaatatataaaataaataaatttaattgcatgcttaggtaagaaaatattgataaaaataattgaatattttatcttatttcataattctaaacagggatttagcacaatatgaaaactagactattcatgtaatcaaaataaaagacaatttttattctaatgttaactcagaaattattttgcttatttaatttaacaattttactgaaaggttaatgagataaataggacagattataattacctaacattgctatggtaacttatatacaaatagctgttcatcaccaaaagtcaaaaaagtaacaagcactgcaacttaagatggattatacaacagaaattagtaccaagttaccttatcttataatattatgttattaaaatgaaattttaaaacaacaccaaaaattaagttggggttacaagtgttgtgcagaaaagatttcatatagcaggcaagaggctgccatccttagaaaggcctgcatgcaaggctggcccttggctggtgtttaggaaattggaaatgggagggtttccaccattccctgagaagagtggctcactgtgtctaaagtgcttatagaaacagtgtatttactctaaacagctgctttccttgtaagagtctggaatttgggtacatgtgagggagagtaacctccatagaaaaacttgggcacttagtctctaatgaaactctggtactggtagacatcactgcacatatgttgtcaaaatgtgagcctgggagaattaagcagatcccgggaactccacaggacagaactcctggaggcttgtgccttgtttcctccagaattgaccacatgcacctttttcctctactaattttgcttgtccccttccttgttatcaattaaagatctgagtatgactatttgttgagtcctgtgagtccttctaatgaaccaccaaacctggggtggtcttgggaaaccttgacacaaattcattgtgtaagatttgtattaagttgatatgatacgtgtaactgtaatcagatggttatttcacagaataactttacctaatctgtttttcttttctttttttgccttgatatttgacttggagattctcgtatttctatatctatccaattgaataaagccatagaaggaataaatgaaaaaataatgtcagaaaataatgtgaaatgagcagcaatcctcttttatctgaataaaaaatagagaatctgggtgattgacaatatgttctacaatatgaatgtttctagaaaaaaaatgaaaaagtggtcaattttctgcaactcaactgggcttcattcctttttataataattttgaaggccaggtgcagtggctcacacttgtaaatccgagcattttgggaggttgaggcaggaggatcacttgagcccggaagttccagaccggcctcggcaatatagtgagacctcatctattaaacaaacaaacaaacaaaaatcccttaaaaagaaaattagccaagtgtggtagtgcatgcctgtagtccaagctacttgggaggctaaggtgaaaggatcatttaaggccagcaagcagaagttgcagtgagccaagatgacaccactgcacaccagtactgacaacagagggagaccctgtattaaaaataaataaacaaataaataattgtgtatcaggccagatgtaaccacacaaaactgtagtcccagctactcaggaggatgaagtaggaggactgcttgagcccaggagttcaaggctacagtgagctatgattgcaccaatgaatagacactgtattctagcctaggcaacatagagagaccccatctcctatgataataataattgattaattgtgcatcattcaagtaaattgtgtaactggagaaaaacatatgactattgaatatactattatagtctactactgaccatagagttcctgtttacttgcttctaatctttttcttcatttctcataaaactgaaaacatgatttaaacccattaaaggcagttcatcacaaaacaagtcaaaaagtcaaaagaattgcatccaaacagtaggatgcgttatccaccgctctctgtgaacagttggatttggtcattaagaatcagcaggacttttaactttgtgtctgtgtgcacaggtgtgtgcacatgtgcacgtgtgtatgtgtatgtatgtaaactatgacagataaaatcattttgcttgtgtacgaatatgtaatataacttgtgcttctcacaaaggaattgcttttccgtctcctgtgctcagtagctgtcttcaaaaaataatctcctatttgtatgggtgcacactggttcagttctacagttcttattgccatttatttatggtaccagaaagggattgctgagttcctggttctaaagatagttactttcttagtgacacaaatcaatatgtaatacagttcacccttgaacagcaagggtttcaactgcagggattcacttatatgcagattttcttctgcctctgcaacagagagacagcaagatccacctctcctcttcctcctcagcctaatcaacctgaagatcatgaagacctttgtcaggactacttatgctttatgaaaagtcaatatgtttctcctgatgatttcctttctaacagcttcatttctctagcttattttattgtgcgaacacagtatataataatgcagcaaaaacaaaataggtgttcatcaactgtttatgttatcaggaaggcttccagtcaattgtgggctattagtagctaaggtgaaggaatcaaaagttatactcagattttcaactgcacagggatcagagtccctcacccccacattattcatgggtcaactgtagttatttgtttactaaatataaacaatttattataaaaatgaaatcgaagatccatttgtataacaagtccaatttgttataatgtgactatagaggaaacatacaacatactaacttaaaaatcttttttcttatttatgcaaaaatattatataggattttagggatcataattaaataaatgaatgttttcagacaataatgtttgagattgtaaattagctacaactaccttcttaaataaatctgaatttcaaactaaagaagttaaattttaaaaattaatttacatatgtatatacatatatacacattcaatttacacatatttttaaactggtcttttttgactgaaactaccttaatcttacatcttactttgtattttcttatcaagagtaggaccaccaagacaagtaagaaattcacaatcagaagtcttacctgatttctcctttttaagtatcttctttttatgttccaaaatttgttgttgaattctatgtatacaaaagtaataaataaaattgccatttttataatgaaataaaaaatattcaccaaacatattaaattccaaaacactttcaagcaatatcagacctaatatcagaattttaatgtcccatacacttcaaatttgtaaaccttacaagcttattaagcttataattaaagaagaaaagaaagtgaagtactcataaatggaggaagcacagctcagtaaatgaactctagttagctggatatcatgcaaagtgtcctgcactcagagtaagtccttgctctgtaaccaaaatacctcgctctgtaggtattttgtcttcagacaagttgcttctcttaggctccatggtttcttctaaaaaacaaggattctgctaccttacttcactaggttgtttggaagatgtaatgagattacatgtttatatgttcagagaaatagtaaagcaatggaataatttattcttgaactttattgctgaaaccattttggaatcccaaataatgctcggtgtgtgtttttctgtaagttctaatactcaaatgttgcagttttcagaaaatgttattaagtgctaattttggttattacttgtattcattgtggcttgtaattcagggcattttacctaattcataacttattactaaatttctatatatataaatttagtgagctcatcactgagctcatcaatcacaccaagggcagaaaactaataggtgtcaaaacctggcttggacaactaccactccttctctacctcctcaaactctgagccagcagatctgtgcttggctgctggatctccatggtcctctccaactaacagacaagacaaaaccctgctttgattgtttttcagttccatgaaggaaatacaagttgacattttctcatttccaagacatgtactaacaacatgtaacatccccttattactcagctctgttcccatttcagagatcaccatacatcaatagtttcatagcgataatcacaatttcaatattgcgtgtcacctgttttggttttgctcacactgcttccttggagctactcaacaaatagtcaaatggcctacctgggactaggcaaaatatggaatgttttctgaatttgtgtgccatccctaggcagtagccatgcttatctgctctgtattgatccaattttaaaatatgtgctgttgaaataagtacaaagccctgtttgatacatggatattcatgagtcatggatgaggcttagctctattaaatccaactcacttacttcagattcagagaattttattgaatggcttcctgtgaggtagaattttaaaatatattgaaaacttgaggaagagctgcaagtagcccaggagattttcatgattatagagacacattacttgaggggccaactgcaagctggttcccactactcagtggaaagataacatggaacattccgctatctaaccaaagctgctgcacaggatataaaaaagcctcaaggtacagatctgatagcaaaagagacagggaactctgatctcttcctgcaacattatttgaacatccctgactattgagaacaatcccaactaatattggttaaaggaaagacaaacatggctctcaaaggataacataccacgaaggcctaggcaaagtctagctaagacgtgggctccaaataaggtttttagtgtagggtgagcatcaacttgctcaatatttgtgtggataaagctaggaggcctagctgccagagcagggtgctgggaacaatgactgagcacaagtacataaactaataaacaccgtagctttgacctctatatatgaatcaccatgaaaactgaggggtctgaatcagtgaaggcatcctggtggcaaaggtcaatcattatcagattgcaggaccagttataatggcaataatacagcaagtgagtccatggaaacaacagaatgattagaatggccttttttccccttcttctgacttgtaaagaaagattgccttccttggacttaggaaaccccttagcttcttggaaaattcaaagaaggaagacacaggagagagccccaggggacaatacatgattttctgttaaactggacattacaagactcaataactaattagaaaagtcaggccaggcatggtggctagcactttcagaggccgaggcagggggattacttgacctcaaaagttcaagaccagccagggcaacagagtgagaccttgtctctacaaaaaaaaaaaaaaaaaaaaaaaaggaaaggaaaggaaaagaaatcaaagacatggctctttttatcccatgcatggggattatacttagaataaaatgaataacattgagatccctagggataaatgtctcaaaaatccagaaaaaatctcgcactctacttctaactaatctagacttctgcttgatttctggctaaaaggtagactaactcttcgctatttcaaactatctgaaccaaactatgaactctcacctaatgcataagatggagtagttgcaattattttaaacttcaatttagcattaactggccttttaacataaacacttactttgtcaaatgatgagaaatagcataatcttctgcatctcgtccacacatgtcttgagcgaagacatcaatattttgcttaagaaggatattgacaatacctggtgagtcatagtatacagcaagcatgagagctgacctaaaacaacaaagaaataactccactcaagaactttaataaagacttttttaaaaagctagtttgatacactttaccagtttaatatccgcctgtcagtatagatgtaataactatttgcatgtactagcttgggtctataagcatctagggtgctcaagtgttcatctttgtaaattgtcaccaaggctaaaagaaagggacaacagggaagcctcttgtcccactggggtaagacataatacaagttgctaacttatagtcctttgatggccaagaaactgtgctgaggtcacttatctaaagtaggcaaagatttagatgaagatttccccattgctttcctagtcaaatcagctaggggtcagataagagttatctgcaggctgaaaacaacaacaacaacaataataataatgacaatgctagtagtcataaactaaaagtccacactttgaaaatgaataaaacttgtcaggtgcagtgtctcatgcctgtaatcccagcactttgggaagccaaggagagcagatcacgaggtcaagagatcaagaccatcctggccaacatggtgaaatcccatctctactaaaaatacaaaaattagctgggcatggtggcgtgcacctgtagtcccagctacttgggaggtcgaggcaggagaatcgcttgaacctgggaggtggagaatgcagtgagctgagatcacaccactgcactccagcctggcaacagagcaagactccatctcaaaaaaaaaaaaaattaataaaactaatacaaaaccctttagctaataaaagattacagtacgaaaaacatctgattataaataccaaactctgtatattataagagaagatgaatcctactatatactattctttatgttactcagtccaaatatttgcttgtctacctgattattcatggtgatatttttcattatatgccaataattatgttaatcttcttattaatatttctgacttgagtgaccactctagaatactcaggttttatttttaaaaaaagaactactgtaccgtctcagcctatcaacggcatgtgaacttgctttccttttcaataaaaattccaccattttctctttcttgcaaattatagcaaataaaagtggggtattattgtcctataaaacagcagaaaaaattaataattcacaaaattacatatttctcaactgaactgaaaatcttctccaggatgctttgaacttcaacatacaatatagaaaggaagtaaatgaaaagcagtcccttcattctcactcctctgtgctttctgatgtgctgtgctttgccttgcaaacaaccctcctctgtctccctggattaactgtggtcattgccaaaactcactttaaacatttactagtcccaagaatccttgctttgatcacagcacttatcatggtacattgtagtcatttcattgtttcccactgaaaccaagagcttcttgaggcaagggcctaaaaccctaagacacagtagcaaatattttaagttttttacattaattaatgatctaaattactatctctaaagcagtgtctcttaaactatattccaaagaatatttgctttatcagaagtattataccgcaagagaaagactccatgaccatctgtatttgagaagtattacaaaactgtattttatgtccaataatcaagaaatctctttaatttcacctaatcccctttcacaatactatttgtggcaaacattaacatttgaggaattaagagtttcagagatacagttgccagagcttcccaatacaggtggcagttccctctgggtggtacaaacttgcttgattcacttttatcaatggtgtcaggatcccagatgccaatgtcaggcactcctgctccaaatgggtcaccatggaaatgagctttgaattaagagagattggcttcaaatgcatttattttccttattattaaatagtccatgggtttttcccctaatacaagagaagagatttttatctttactgttagaaagctcagtatattctgtgtaagagagataggtttaaaaaacttaagaacaaatattttaaaaaccaaaactcagtaagaaatactattctcaattataatggtaatcccgggaccctagtgcagctctactttttaaatccatttttactggcttccacttaaatggctacttaaaattattttttattttagacaaaatataaatcagaaataaaaacataatggcttatcaatagaagttctcatactgatccacatggattatttctggcataatacaagccaataagtcacttgcatccttaaggaagagcactgaggagaaggatgtactgtctgcaatattcataaattatccaactataaccaggaataacctaaaaaggcttctaggcattcttatgggcagagaattatttgtggtatatataaagaaaagagttaaaaacttctaaactctaaaattcaactccataactgagggatttatatactctatagactatatattataaacaaatacatgctgacttaaaaaccttgaaatttttatcaaaatatactataacataggagttgtaaactcagatacttacaaggacaaaggaaggttgcctgagtaagggaagtactaaggtgggcacagtagcaaactggagaatacctgccttctataaaggggcaacttctgcacagcagaccaaagaatgatagaaactcaggggacaccagatttgattttttaggatatgcctgaagtccacatttcttcacgagtcttctaaattttacatgttgattcaacttatagaggcaaacaaacaaatctgtgtaccacattagaatacagcccttgttttttttatattcgctattaatgtgttactaaatggttgtgtataatccaagtattttcatgtaaaatattttctttctctggtatcatatgttctaccaaaaaatcaggctctcatatataataaaaattgctaaaaagactcacaatacctgcttcaagaatttttccaacatgtattcatttaaaatatgtttgtatataattttcccagattgttaaccaaatagataattggttcacaagactgctaaaactaaattattaaaagaattcctatctatattcttattaacttcatggatttcagtgtttaaaactgacattttgggtatgctaaagttctataaacttaacaaacatactgagatagttcataacaaaacttcaactaaaaaaaatagtttaggatttgctactattctaattgagaaagccaaacttgtaatgaacatttgttgacacataatcacctgcgtggtgacaaagggacatgaaatcatgaaagggtcagcctctacctattgaaagattactcataagcaaatttctgaagactctctgaatggtagtgaatgattcatggtgggaagcaaaacatgttattctgtaagctgagagatattgccaatgatattacctttcacttcccagtcacagatgtagagaaagacagataagtcaggctaatataattgaaaaggagaactttgaaggaagtggcaactatcaaatgccaactcttctagagatttcttacatttttgagatacagaaatttatatattgcacttatctattctggggtttttaatcaagagtgtatcccaaccttgaaggttttttgtttttttgtggggtttttttttggctattattgttgttagagacaagagtctcactatgttgctcaagctggattcaaactcttaggctcaagctgggactacaggaatacaccactgtgcccagcttcaagaaaacatttttaaacacgttcaggccttaataggtctattacatcaaaatcttcaggggaaagcctacaattgtagatttttaacaaaatgtcctcaggtcactgtaatgcacaattctgagaatcagtgcagcagacaatcacttcagtctcacctctcacccacatggctaattcctttatcagttggagatgtggccaaaaagagaaaagagtaagagatagtgtcatttattaaaactccagttaagtttcctggctacgggtagaacagggacaagtaaactcaaaatcccacttgattttgctatttacaagctccttatctcccaccttcccactaagacattctagatttgagaggaggctttaggttcttatctaagtggctgtttctgccaggatgagcaataagtcagttaataatttgttccaccttctgctgaagtgtttctcacttcgtcaccacatattcactgccaatctggtttcctcagagtcctcctaaaattcatctctaggcaagttgcaattcattctttttcaaaccaaaaattattagacccaaagctaaacagcaccttgtctcaacacataaaacaaacttaaaaacaaaaaaaaacctcttcctggcattttccctcattatctaatatccaagtgacctgcatatttctgattgctctctttctcccctcccatttttccctcttaagccttgccactgaaagatgatacatcagtttttcagaaaattagcagcaacagcaacatgtccctttattgtaagttgctttagttttgtttgagttttaagataaagcctaattccggggaatattttctttcctgtgttgttttacactaattaagaaaaaaaaaaaaaaaagaataagcctgtgtagaaaaaaagttgaaaaggttttacctttaacaaattcacaaatattttccaaagtgcattttataaagctgtgccctttaatgcttctttaaaaatatcaatatttaaaataaaatcttagacaattaagttatttcaaaataacttaatttgtatttgcattcagggaatggttgagcttccaaatataaaaaattgacccttacctatgtcaatgttaaaacaaatattttggaaagaaagttgattgacctataccttgtccagtgcttcaatatgtgcaccatgggaaagcagtttttctgccagtgaggtgctctcactatacacggcataatggagagcagtgttgccgtagatatccttaaggtttggattggcgccatgttccagcagaataacggcacaagcctcttcctggcaatggacagcctgtccgtgttagaccaagaaacagattgtaaattccaagaattcaaaatacacattccacaggtttcaccaactagttatatgtaaatgagatcaatttattttaattctatatatgtaaatcaaatccatgtcatgctaaaagagttggctctaatatacctgtatcaaaggcgttctgttttctttgtcacagacatcaatctggcattttctgttaaccaggagagtgaccacttgcacatggccactggcacaggccaagtgtagagcagttctatgagagtaagaggattttttaagaaactgtagtacaatatctcaaaacatacaatcattcatgtaatgtaaaaactgaatagcatgtttttcctctgccttcaaaacaaataaattttttgaagaaagtacaatacttactagctcttattgctcactgccttaatgaaaacagcagcctatttgagtagaaagagctcagtctttggattcggttcaactagggcttgagtcctactttaagccttgacacttaccaactattgcttagcctttctgtacctcaacttcctcattaataaagatgacaatagtagctatctcataggacaccatcgtgatgcttaaatgagaagctatgtaaagtatgtagaacagttcctacgacaactcaataattgtaagatttttgttttttgagacaaagtctcactcttttgcccaggctggagtgcaatggtgtaactatacctggaactcctgggtcaaatgatcctccatccccagcctcctgagtagctgggactacagatgagcaccagcatgcccagctatttatttaaaaatttttgtagagtaagaatctcactttgttgcccaggctggtctcaaactcctggcatcaagcaatcctctcaccccagcctcccaaagttctgggattacaggtgtgagccactgcacccagccagatattataattattactattactactacttaacaaaaccattttaattaggtagaatgatacaattatacctactttgcaagatgacttaacgagtaggtcacattttaacacctctgacattggaatgccacttataattcatgatttgttataactataattggtagcattttaaaaattatcttattgatatataaaatatcggggcatcacgcaatccatgagaccttacattaagtagaatatggtatactcagcaggtctagggcagttctaggcatgtaactgaaacttaaatacattttagttcttaaaggtactatggggaaagagcactgaaataacaataatgcattttttaaacaaattaattctttgattttcaaacaacttgaaaccaaaggaaactcatgattcaaatgaatacatatggctcattgtattcaatatttatacttagaaaatatatgcaaatacgactttccaatgattaatattagtatttaagactgataaactttcgaaagagcagttaaaggttatcttctactattttctaacttcagaaatgcttttgtttgaaaggtgggagataaagtttcaaggagattaagtcccaatattcctattttaaatctctcagcttgtgcaggcggggcaggtaaacatgaagtgtttaaggatggacgggtcctgagagatgatagaatatgtctgctacatagcaggtactcaggttatgcttgatccataaatggaatgaaagaatggataaatacagttggggagttcattatttttaaataaactcctataaagcaatatttttgcaatagtaattatttatatgtgttgttttatttttaaagaacacaattaaaatgaaatgattatgtttgcataaatggaatgagtatataagcaaaacatatgtacataataaaatatatagataataaaatctggaaacagataaaaacattccttttttacttctgaagaggctaaaagctcaaagaagataacaacacacacaataatgataaaaaatagaaagtgagaaattattttcatcagcgcaagattcatattcctctcttcccaaggattagtccattaataataaacttttactagaagttttgtactcactgcagcaatcacagataagaaaaaggaaaaaaactttacttaaaatacaaatgctcagaaattacaaattttatattttgtacatatttttgctaaaacaagaccatagtatgtttgtgtatgtataatttaactaattttttctccttgctagctataacaaaatacatctttgcacatcaacgtacttctgtatctactgccaccttcagtggtcacatattattccatcctatggatgcaactgaaatttatttataggatccattctatgggttctctttaaagtaagtactgtgaaaaataaagtgcatgtatctttatttcctaagggtattttagtataatggaattggtgggtaaagggcatacacattttttaaatgtagtacttaccattttcaaatgagtactttgaaaagtaatcagcaacttcaagcagcagtataaaacatcctcacaaatattgtggatagaaaactgtttcattcctcttttagtttaaattcttataccagaaatgcgaaggattttttcctatgtatataagtaacttgtagatctggaaaaaggtactttgcccacttttagagtgtttgatgatttgatttgaaagaatttcctgtaaaatgaagaggtacttttcatctaatgtgtatatataactgatatatataacatattatatgtgttatatatgtatacatatcagtaatatatatatatcttatgatatataataaacaacataggccaggcgcggtggctcacacctgtaatcctagcgctttgggaggcggaggcgggcagatgacttgaggtcaggagttcgagaccagcctggccaacgtggtgaaactaaatatacaaaaattagccaggcatgctggcacctgcctgcaatcccagctacttgggaggctgaggtaggaaaattgcttgaacccggcaggcagaggttgcagtgagccaagattgtgccattggacaccagcctgggcaaagaagcgagactccgactcaaaaaaaaaaaaaaagaatataatgaattccctataaaatgaaaacatacttttcatctgaaaaaatatatatatataatatagtaaatatttttcaagtaagctctcttatctgagaacttttcgcccactgaaacaactcacggttatttttgataggggaacaagtactctcattaggcacctcctataatgtatataaaccatgttttaaacgtgtacgttaaaaataacaacgctgtatatgcttaactttgtgagttaaatcactcaaattctccaactgctccagccagggaattatgagggatggaaaacagatgagagtccgtttggctccgccgctccgagggtgcccggcgccctgcacggccccgtcccagggtctgcggggaagccgggcctgggggccccctcccacccccggctgagcccccgctacctgtgctgcttgtccagggcgtccaggtctccgctcctgcgcgccaggcagcgctccacctccgcggcgtcgcctttgacagctgccctgtggatcttctgcagttcggagtcccggattcggtatccggaacccgtgtagacgtggtctatggagccctgggccgtctggcccctgcggctcccgaagccgaataacttcatattggtgacttcttctcagacccccaaccaccggctcttgagcgagggcagctccctgtcaccttttcaccacccccctccccgaccccggccgacccagccccaaatcccctatccaaccccaaagccccgatccaaccccaactccgctatttcaaatctataatctactccacaatccgcgatccagcccggtccaccacagccttcagcagcgacactcgcagcctccgacctctcagaccgagtgagcctcgcaaagccgttgggcgcgcgcctgcacggcagttgctgccgggctcccagaagacgctccctggcggcgcgcgcctgcaccgcggttgctgccgggctcccggaagacgctccctagaggcgcgcgccagcaggtggggctgcagctccgggcgtgcgccgatgggctcgccggttctcctgggatcgcccgggcggccccaggatcgcaggcgcgcagccagcccggcctgagaaggagggcctgtctggccttgcagcccgccccgctcctcctcggaagggagatacggtgctggcaagggcactccgcggccacctgagtggcttcgcggattggctgaacgctgaggctctggccctgaaatctgtgtggctagtgtcaggtagctggagagggatggaggcagagtcaggggctgctccttcccccacccgccctcactgctgccagtgccacacgcgcggtttgcagctgcagatctggcactggcgcaggttggcggagcttcctttggatggcctcagggccgcagagcgcacagcccacctggcctcaaggtccgctcctcttggacatctttctggatcctgggccctggcgctgggcactctgtgtccacacggatgaaacagcggctgctggcggggccggttgcctgattttgccgcctgggggtctggcctcaggatccacgctactgcggggcgggcctggtctggagtgtccagtcacttgctgccggtgcaccacgtctagactgcagctgcggctccgatgccggcgtgagctggcgggcctggtacctgatgtcctcagggtcaagtgcatcgccctcccacttgagaggttgctctgacttggcctcctccaagaacgcaggggccgccgggactggctcttcgtggtaaccgggatggtaccgagcagcaggttttcaccctggtgccactgctgtgcggactgcctgacttgggcgcccaggcacccgccccagggtccgcgcggcaggtgtgcaggtagggtgagtggcgcggagggttgggggttgctccgtcatctctgcccgtgtgcaacttgcagttttgcagttttctgcagcagctgaggcgctggcgcgggaaggcggagctcccctggatggcgtcaggtttgcgggcacagagcacagcccaccaggcctgaaggtccgctcaggggccatagtggttgagttctctgtggaactgggatggggtgaacagccagttcccgtcctttggccgcctggccaactgccagacttaaccgctgccgcccaggcatctgtctctagcgttgccactacttgggtagaagtgggggtcggggtggggcgtggagcgtcaccggttgccaagccagcactgtctttgcaacatattcagatggcggcgggcagctcgggcgccagcatgggctggcggggctcccctggacggccctcaggtcgctcacagcattgtcccaggacttcctcggcctgtgccaggtgggcaaggtacaggggtagcttccaaggcttctatcccaactctacctatttctacctattttctcttgagttattttgcctttatctcagttttatttgcaaaaatagtatacgcaaaatacatcgagtgaatgcacatcaggcatatagaagatctggcagaaacatgttttctcctgctcatttccagtcagtatttgaacacagaggcttccacggttttgattctttccacaaaaggttagttttgtctgttttcaccatttatgtaagtgaaactataaattatataatttttatgttcactcactaaacatgcttgtgacacatcattttgctcctattgattattcattattttgtaatattcaattttatgactataccacaggtttgaggcctttgcttgttttgtttttaatccattccactattgatagacacaaaagcagtttctgatttgaggctatcatgaataaacctgctacgaacaaatcagatatacatatttttttctgtaataatattttcacttttcttgagtttaagtacataagagtggattttctgggttataaaataagtatatatttggcattgtatgaaatggggagacattttcctaagtggttatgccatcttaaactacaatgaaaatgagagaatcagttccactttccaaccaatacttgatgctgtcagttgttttagtattatccattcttatgggatataactgctgagtagctgtctgccttctcccataacacagaaaattgagggcccagaggacagttttattttcatatttgacatcttctattattttttatagaaggatgatttcagtagtaaaattttctttcaattttctaggttgtctctgaatcttactggggttccttgtcctaaaccacattcagaaattttcacgaccgacttcttatctttgtcataccaggccaatgagggacagcattcctgagactttttaagtactttgtgtgtgtgtgatggtctaataatcatagccttaaaactttctggctgggcatggtggctcacacctgtaatcccagcacttcaagaggccgaagcgggtggatcacctgaggtcgggagttcgagaccagcctgaccaacgtggagaaaccccaactctactaaaaataaaaaattagctgagcatggtggcacatgcctgtaatcccagctacttgggaggcaggagctacttgggctgatgcaggagaattgcttgaacccatgaagtggaggttgcagttagccaagatcacaccattgcactccagcctgggcaacaagagtgaaattctgtctcaaaaaaaaaaaaaaaaaaaaaaaagaatctcacacttctgggagacactgaatttgtgaatgtgtacagcatatcacaataacttttctttgagaccaagtctcactctgctgcccaagctggagtgcagtggcccatctcagctcactgcaacctctgcctcccggattcaagcaattctcctgtcttggcctcccgagtagctgggattacaggtgctgcaaccatgcctggctaatttttgtatttttagtagagacagggtttcacatattggccaggctggtctcgaactcctcacctcagatgatctacccgcctcggcctctcgaagtgctggaattacaggtgtgagccaccatgcccagccagaaagttttaaggctatgattattagaccatcacacaaagtacttaaaaagtctcaggaatgctgtccctcattgggaccacaacacccagataattttttttttttgtagaaagagaagccttgctatgttgcccaagctggcctcaaactcccaccctcaagagatctgcccatctcgacaaccagagtaactggttctacaggaaaataccactatcccatgataattatattttattaagttttatttgcatagacaggaggtcttgctatgttgcccagggtggtctcagactcctggacttgaacaattctcccatctgtgccatctgtgcctcccaaagtgctcccaaagtgctgacgccacaggcataagccactgcacctggcccgacttaagatgtctttaatctagcatcccatacttcatataatcaggaaaagcagtagtgtttttttttttttaattacttagtatctcaacaagaatcaaccatctctcaccattgccaggaccctggtcagaaccactatcatctcctacctggatgttgccacagcttggcctccgtgcttctacccaaatcttcccacaatctttctcaactcagccaccatgggatgcttttaaatcaatagacagttcgtgtcacctctctgctcagaacccttctgcatctcccatctcagacagcataaaagccaaagccccagcaatagcctcccagggcttgcacaatctgtactgatctgagtcccacaactccctggcctcctcccctaccttctctccccctctctgctcgacaatcctctttcctgagcttcagacacaccacggagttccctcttagcatctttattctgttgtttctgcctataatgctcttccctcagtaccttggccagctccttcccctccttcaagtctttgctcaattttcacttaggaggccaaccctgaccactctatttaatattgctatgtgtccccattcctgccatgctcactcatttctttttactttttttttaagatataatctcgctgtgtcactcaggctggggcaccatggcacgatcacaacacactgagacctggaactcctaggtcaagaaatcgtcctgcctcagcgcctctagtagctaagactacaagtgcatgccactacacccgctaatttttttttcccatgtagacagggtatcactttgttgcccaggcttatcttgaactcctgggccagagcaaccatcctgcctcagcctcctaaatagctggaattataggtgtgggccactacccctggcttcatgttcatttcttcttgctgctgttacaaactaccctacgttgagtggcttaatacaccacaaatctactacctaacaggtctgggggccagaagtccaaaataggtctattaaggctaaagtcaaggtgtcagcaggactgcatcccttctggaggttccagagagaagatgttcccttgcctttcccagttccaaaagccacccctattctttgcctcatggaccctaaatgcatcttcaaagccagaagcaaagcatattcaaatctccctctgtgacctgtgcttccatcatcaaatctccttcaattctgactctcttaccccctctttcacttataaagacctcttgtgattgctggacacagaggccggggctcacaaccataatcccaacagtttaggaggtcaaagcaggagaaatgcttgaggccagaagttcgggaccagcctgggaaacacagtgagaccccccccctcaattaaacaacaaaaagaaataagagaaaattagctgggcatggtggtatgcatctgtagtttcagctacttgagaggctgtcgtgaaaggattgctttagccccagagttcaagaccagcctcggcaatataacaagatcccatctctacaaaaaaatacaaaaatcagctgggcatggatggtgtgcacctgtagtcccagatgcttggaaggctgaggcgggagaattgcttgagcccaggtggttgaggctgcagttagctacgactgcatcattgcactccagattgggtgaaacagagactctgtgttcaaaagaaaaagaaaaaaaatacacatttggtttctgcccctcgtcctggcacagagcttctcaagttcttataaaggccttggtgataaaggtgataggaccatcttttgtttgaatatttggtcttagtcccaggtttctaacacaagagcctctaagacctttgggatcaccatagtaagaatgcatttggtgatgttactgagatgactgggtgactgaaagctcctagacagcttaagaaaaagggctggttgccagaagaacaaaccatgtgattagaggcttggaactgtcagcctcacccactgggctccaggaagaaatagtggccgaagactgacttaatcaccaatagtcaatgatttcatctatcatgcctgcctaaagaagccttcataaatgacctcaacaaccagatttggagaatgccggggttgctgaacacaagggagataacaggaaggtaacacgcgcaatagagagcatggaagttctgcacccctcccgacctcccgacacaccttgccctgtggtttttttttttttgaaacagggtctggctctgtcccccagcctagagtgccgtggcacaatcgtggctcactgcgacctatgcctccctagctcaagccccatctctcatcctctcacctcagcctcctgagtaactagaattataggcactgagtagccagaactatagatcactgcacctggctaatttttagaaaaacctttttgtagagatgcgttttcaccgtgttacccaggctggtcttaatctcctgagcacttaagcgatgctcccgcctcagtctcccaaagagctgaaattacaggcatgagccactgtgcccagcatgtacatctctttcaccggctgtttctgagatatagcctttaaaatgaaccagtaaaagaaagtaaattggtgagatgcagtggctcacacccataatcccagcattttgtgaagttgaggtgggaggatcatgtgagcccagaaatttgagaccagcctgggcaacataacaagaccccttctctacaaaaaataaaaaaacttagccagatatgctggtgcgggcctgtagtctcagctatttgggaggctgaggtgggaggatcacttgagcccaggagtcccatgctacagtgagctttgatcacaccactgcattccagtctggcaacagactgagaccctgtatctcagaaaaaaaaaaaaaaacaatctgtttttctgagttctgcaagctgtccgagcaaatgattccacccagcaacggggtcatgaaaccctgttttctaactggtcggtcaaaactacatgtaacaacccaagacttgcaattggcatgtggagtgagggtacactcctgggactgagcccccatcctgcggggtctgcactaactccagggagtgtcaggatggaattgtgggatacccagttgggatccagattgtctgaaaatcagtgtagaaactccacatgcacatttggttagaggtgtttaaccataactactattcacgaaaaaggtctactcattacaactgaaaatcataaaattgtaagttctacaaaaataagtcaaccttatctactgcccagtcctaccaaactacagaatgtgagaacagaaggtctgaccgtggactcgagagctgacattaggaatgtcaccaccatcctgctctccaaggactcctcatcttcaacaaactcctcatcttcaatgggcagagtggaaactgcaacttgtgccatgatccttgcacaagaaaagtagtaagaaagtgagtggtagaaatccagtgtcctaaactcacatccagagctgtgagagcttttccaccggctggataattcacagttttcttgaatcaggggaaaaataagactcagaaactaggaattcgttttgcccaaaactctcatcagatagagaatccatccactaactttctgtctagtattatttccataagttagatcagtatcactcccaaaacaaatgcacatggcacccagaatctgcgcatttctcccaagtaaaagaggaggtggatgggcgcagtgtctcatgcctgtaaccccagcactttcggaggccaaggtgggtggatcacttgaggtcaggagttcaacaccagcctggccaacatggtgataccgtctctactaaaaataaaaaaaattagccaggtgtggtggcacgtgcctatagtcccagcttcttgggaggctgaggcaggagaatcgcttgaacccaggaggctgaggttgcagtgagcagagatctcagcactgcacctgagcctgggtgacagagtgagactctgtctcaaaaaaaaaaaggggggggaggaggcaatgcactttacaacccagtgatgggctaccacaactcaacacagcaaagaggtgccaagctccctttctcccctgcacaacccgacacagaagagttggtgcagtggaatgaggttgaatggagagaagttcctcttctttccatttttttttttttttttttttgagatggagtctcactctatcacacaggctgggtgcagtggcgcaatctcggtcactgcaacctccgcctcccaggttcaaccaattctctgcctcagccttccgagtagctgggattagaggtgcccgccaccacacccagctaatttttgtttgtttgtttgtttagtagagactgggtttcactatgttggccaggctggtcttgaactcctgaccttgtgatccacctgcctcggcctcccaaagtgctgggattacaggcatgagctgctgcgcccagccaagaagttcctcttcttactgagaaaatggatcacagggcatcaagtaacacataaaattctttataataagcagtattatttttggaaaacctttcctaatattttggtatcagcaaaaaccctcagattaatttcaaacactataaaaatacaatacataaacagaaaatattaactgtcagcaatgctatagagaaattggaagctgtatgcattgccttttggaatgtaaaatggtacagcccactgtggaaaatggtttagcagctccttaaaaatattaagcacagaattatatgatccaccaacaccctttaagtgtatatacccaaaataactgagagcagggactcaaacaggtatttgtacacccgtttaacagcagcattattcacagtggccaaaaggtagaaccaaccctaatgcccatcagtaggtgaatggataaagaaaatgtaatatatacatacacagagtattattcagccataaaaagaaaaatatctggccagattcaggggcttacacctgtaatcccagtattttgggaggccaaggtgggcaggtctcttgagccccgaattttgagaccaggctggacaacatggcacatttggtcagaagtgtttgaccataattactattcaagaaaaagatctactcattagaactataaatcataaaattataaattctacaaaaacaaatcaaccttatctaccacccagtactacccaattacagaatgttagaacagaaggtctcaccatggactcaagagctgatatgagcaatgtcaccaccatcctgttctctgcggactcatcttcaacagactcatcttcaacggactcctcatcttccacggactcctcatcttcaatgggcagggtggaaactgcagcttgtgccatgatccctgtgcaagaaaagtagtaagaaattgaatggtagaaatccagtatcctaaactcacatccagagctgtgagagtttttcactggctggcaaattgtttctttgcatcagagaaaaaaacaaaacttggtaacttggtattcgatttgcccaaaactctcatcagatagagaattcatccgctaactttctatctagtattatttccatgaagttagatgaatatcactcccaaaataaatccacgtggcaaccagaatcaatgcatttctcccaagaggaggtggccaagcgcccacatctgtaatcccagcatgttgggaggccgaggtgggtggatcaggaggtcaaaagattgagaccatcctggccaacatggtgaaaccctggtctctaccaaaaatacaaaaaatagctggatgtggtggtctgtgcctataatcccagctacttaggaggctgaggcaggagaatcacttgaaccagggaatcagaggttgcagtgagccgagatcgtgccactgcactctagcctggtgacagagcaagacttcgtctaaaaaaaaaaaaagaaaaaaacagtaaaatacaaaatgtctttttctcctaaccttcttagccttctgctggtacttcaatttctgctggtactgtttggtcattgccctctaaagaatgatggcttcctaaaaagaaaacaaacaacatataaaccaataaaaactcacattgaaagataaaaaataatctaggtgacgatgcaagcacttttaagacataataggccaggtgcagtggctcacacctgtaaacccagcagtttgggaggctgaggagggcggatcacctgagttcaggagttcgagaccagcctgggccaacatggtgaaacctcatatctactaaaatacaagaaatcagccaggtgtggtggcaggggcctgtaatcccacctactcgggaggctgaggcaggagaatcacttgaacccaggagacggaggttgcagtgagctgagatcgcgccgctgcactccagcctgggtgacgagagtgaaactccatctcaggaaaaaaaaaaaaagacataataaacataaaatatgattctattaactctattaatccaaataacgttttctaattcagaagaaatatataacatgtctatttggtagcttaaaaacattcttttaaaatacaaatacagtagacccaagtaggcttggggacttaatattagttactctagctacatgataaaattactggatattggaatctgaagcagcacaattatgctacaagtaccatgctcatctgtcactgacacacacacacaagtgtgaatgcctgctttgctcaattaactctgtaaataagttcaggatttgctgtggaatgttccctgctttccattttcactatggtgaaagttatggaaactcgatccccataatttaagcaaagttgtacttaaagtaactcatatgtaaaaatttaagatactacctttagtgtcaaaaacattttaatccaagtaacgtaatctgcctgcttctaaaaactggcatataaagcaacagatctgttaggcagtcacaaggtaaacaggctcatcctactggagcagaagttttactcacaaatatgaaagaaataatctaaaatatcagagtgccacttaggattaagaccacaaactgcccccagtacacatcctctgtccttaaagatctgagctactaacatggaaaagattgaaaaacactgtcttcaagtataaataaaaatatattacatttcggtaagaatacattgtttagggggaagggaagcagatgctcatctattttgtcctatctgttgataactaaattcagaagctgtactaaaagtcaaacaaaagttataaatacatctcaatttttaaagagcaatgattacagtcagaaaaactcatttggtggctagtattcttgaattaaaagtgccataccaaagtgaaatctttttggttttcaacatctagctttttcatgtcacaattattttgggattcttttccacttactgcatattgtgaaaactcacctgaactcaaaactctaggtaaatctataaacctgtatctcagaatccacctttaattcatttgtaaaatacactttctctgcacacatttcctctctcttcttttaaccgtaatatttggatttagggagcatcaagttccttgactgtaaagtcaacgaaaaaagagatatgaagtcaaaagaatgggagataatgaacaagaggccagtagttaaaaagtaaaatttcaataaagaataacagttaagatggtcgttcatgttattacccaaacactaggggtttcgtccaggtcctcctgctcatcggagaaaaagccagtcactgaggtgacaagtactgccaaggaagaaagctttaacctggtgctgcggcccaggagctggaagctcagtctcaaatccatgggcttgactaataggggcaggaaaaaaatttaacaatgtataagagaacagaaattagggaggggcaggaggcatgtggtgctgtgatctggtatgtttcagttatctgatacttcctgaaggtctttttttgaggagagaactcagatacaacagatccaagtttcaagctttaacagcagggtcaattttgacgttcatccaaaaaaaacccatccattgggacaacagggccggtgtcaatgtaagcaatgattctgtagttcctctttgttctttcaaaatctgaaataaacaattgaatttatattatatgctaaatctaaagaaaatacatcttgttgtacttgaggccagaagagatagaagtaaggcagtcaagtttgggaacattataaaaaattcaaaaaaagtaataaatgcataaaacttacagagtaacaagtgctatttcagaattcttctaaatactaagtattgacatgaccttatcaatatttgcattactaaccatacaataagaacctgacttctgactgttctgagataagggataaatgtgtactttaccttaaatgggaaagtgcatcatgtacccacttcgagattcacaacagggaaaactgatttgaaaaattgttgcttgtgaagttcatttatatgttaaaaaaaggccaatacattttcccttttccacatagaaaaggaacactatacttataaatactaaaacacagtctgtggaatacaaggaaccaatagaaacagtatgtaggaaaatggaagtgaaaagattatacattgcaaagacttcagtagaaggagtttttcatcaacatcatcagtttcagaagggcctgctttgggatacaaagacaatacttcaacagtaactcccccaagccagacgcagtgacttatgcctgtaatcccagtaatttgggaggccaaggcaggcagtgaggtctggagttcaagacaaacctggcccaacagggtgatacaccgtctctaccaaaaaatacaaaaattaaccaggtgtagtggcatgcacctatacagtcccagctatatgggaggctgaggcaaatgtactcattttttcattcctgcacccaagaaactgcaaccaatctactctgttaagagcagagataaagggtttagactccatattacatgtgaaatagaagaaatgaatcagtttagtatgaacttgtatgcacttttggagaggaaagtaggtcaagaagccattaagatacatgaaggaaggtcaaatcttaaagaaaactagaaattcagatttatttacatagctctagaaggaagaaccaggaatagtggagaatgaatgtagaaaacatttttagtgaatgaaagcatgagatgataacacaagcagccaccaatggaacaaactgatgtgcaacagcggatttgccgtcactgaagctatccagtttccaactgttgcaggtattacagagctatcaagagttttagtaggcggctggggttcctttcagatctgacatggcatgatgccaaaatgctgtacatgttctcatctttttatggctcattttttttctctcttcaggtttcttaaccttttatctacttccctctattaataatcacctaaaccatacactcagtcttctgaagtaaatttctttatctttcacttcacaaataaacatctttgatggatgaaaacaccgcaggaaagccacctaagcagatatgacttctcaacttttttttttaagtgatttccattcatcactaattccaaacaaaacaattacaaactatcataaaattattagaaagtgaaaatgggaagcattggttaaatatgtgtttagtatgcttcaccatgtcctcaaacatatttaaaaagttaatccacacttctttaagtgcattgggggacttgctttagattaagaaatatgttaactatttcaggacactaaggaccttacaaatctgaattagctcagattggctgctatctcctcaattattttctgataaataagaaacaaacagtaaatagcaacttgcagaaaatctaccagtagtacacaagggcagccaaacttcaaaattcttgccactcaaactctagacggttactatttactaaaatgtaaataataaaaagacttttctcaatcttgtcctccagaaagaaaagccataaagttcaaacactaaccaaaaaaagggtaaggagaaacgtttatatattggcgttccttttattagtgtcttcacatacaacactcctcaattttaaacaccgctttctttcagaagacaaaaccaagacaaaatggtagaaatcaaagggttacagactttgatttaaaaggcataaccttttcaaaaatgagagctatcgatggaacacttctgagaagaaattccctggcactaggatagaggttggaaaaccatctttccaggtgctctaaaatagaatcctctcatagtgcaagagtccttctaattctaggggtctaggattatttttattattattgttacctttcccgttctggaaaaccctcaagactctgtcttgtaaatgtcaccaacccagtaggttctacagaagcaataaaagaaaaacatacccaaaataagtttcaattttgaaaacattatacacacacacgtgcacgcgcgcgcacacacactcgataaaagaataggtctaacattgactataaaactaaccaggaaatacaaagcctagcattggaaaataacagaatattgattgaaaatattatccttacagtagaaactcctataaaacagtaagacttcactaaacgaaactatacaaataacagcacaacagtaggatttgagtgctggtactttttggtaaagttttgaagctgaatacacttttaaaaataaaaccattgaaaaaaaggatgtataactggtacagcttatgcagtaaagacaaaactgaattcaaatttgtagactcctttacaaagaaaggacttaaccctacattcaaagactggtgaataaagacacatttatgtactttgtagtaaagtgaaatgccacagctttaaaaagaaaatcatttgcacatcctctgaagttagtaaagctaagtttcaggcttagatagtgggcaatcactctacttgttagtagcagtcttagccagagaagaaattactggttctaagagtttacagaataaagatgacatatttttcaagaagcaatacatttgggaggatcaaaatggagtagtattaatgtagtcaataattttaagaggatgagatccttttctagtcagatttatttattttttaaagctagtagcaaaagaaacaaatatatcagctggccagaagtaatttgtctgactcaaatcaaagagcaaactaaaaaggctatgccatttctgttttcttgaatagaaaaaagctcttaaggaaagagagagatgtcaggaactattactgatgacagtgtataacccagtgaaagcctggccatcatttcattcctatgcacaattccacatttccttgttctcagtcaaaagcaggaaccactcaaaaaccatacggagcagttgcagaagaaaacaaaattttttgttaacataggtcttacattctttagatatctaactttaagataaacggataacatatttaaaactcacgagtaagtggtcaaacaactctaacactagagatgcaattccatgaatataatagaaaacatctctcttgtcattcggtaacttagcagagaagtaagaacaccaaatgtccttcatatatactaagagatgctaagagaaattcgtaaacactgctggcaaagcaagaaaaggcagaagaacatggtttctcagattaacaaaaaatgccttgagagcatgtctgttagctttctttttcataacaaggcaactttcatctcagaataggatactctgattaatcaaatacttcccataataaaatcacaatatatactacatacaggtcataaattttcaaaaatctgatctataagatactttatctaaaactatataaaaagtaatttaattcagaaggctttttaaaacatttcagtctcaagatcctcatcaaatataaaatacacgtttaacaatcctgaaaagttggtcctgatggaattctattttatcaattctaaaaggcgggtttttccacatactacatttctgaaactggaatacatcttttataatggaggtatcttaccataggtctagactagaggagaattttcccagagaagatgtgcatctgcttctgctgtcatctgggaacactatcagcccaacaccatctgaattaatcctttgtggcaggcctttgtggaccacactggtggtaaggctgcacacccaaagcttagggtttgtggttcaaattctcagagaaatgtttctttctttctctatttagtgtcaaggttgagacttgcatgcttctttatggtcccttttctggatggtcaagttaatttctcatttatccctaggtgtaccagccttgtgggttaggtctcctactaaactccctgtcctgagtgttttttccttcttagaggtatataatgtaatagcactttttaaaaataatctatgacatcttagattcgatgaaatatggtaccttaaataagcttctcaagtctattgagtaggctccagaacttctacacaacgactcattatactgcaacctcttttattctctttaggatttcctctttaaaccgttagctttacatactgcagaccaagagcaatgttgtactgtatttctacaaagaacttaattaacatgtacagtaaaaaagtcagaaaataaaatgtctagttataatttatttcttcaaattccaaatacttataatggcatatacatttctagtttaaaaaacaaacttttagctttttcctcaaagtatctgaaatcctaaaatgtagaaagccaagttagtttttagagaagacatacatgatttgactcccaggacaaaaaagtaaactctgtactacttagttataacaattctacttaaaacggcaactcaaagtactgtaaaaacaaaacaaaaaagaccaacagtaataattctacttagacctagaatagccaaaaaaaagtagtcatttttttttttagacataatcttgctctgtcacccaggctagagtgcagtggcacaatctcagctcactgcaacctccacttcctgggttcaagtgattcttgtgcctcagcctcccaagtagctgggattacaggctcctgccaccacacctggctaatttttttattttttattagagacggggtttcaccatcttgaccaagctggtctggaactcctgacctcgtgatccaccacgcctggccttacgtagtcatctttttaacaagtcattacaaattctaatttgattttgtgtctcataggtccaaatgattctgcattttaatatttcattcagtacagggcacaaaactgaaattcaataagctatgagataaataattccgtatcagagaagcatataattttcccttaaatattaaaatcctgataattgatttcattctaaaaatttaacaatgtccaatagcaatacattcaagggggaagatgccaagtacactgtaatgcaagagtaaaagaaggatatgagaaaaatgaccttaaaattattcaaagacatgttttaagacaatcctacaacccagaactgaaaaaaagccatttcacttgaccaggttgacattacctacttagcacaaagaaacttttaaggtgttctggtttacatccacttgtaggaaaggcgacccattgataatagcttacatttattaagcatgtatctccttgtttaatatctataactaccctgtaagataataacattatattatttcataggtgataaaactgaagcttagaggtgtcaagaaacttgaccacagtcattcagcttctgagataagagtggcaataccaatctattatcagctggtcattaccagtatttgttggacatttactattactgcctcagctgctatcaggttttggggaagcaagaatgttaaggttcaatagaggaagatggatataaaactcagtacaaaacagttttatgagaactccacaaagggcttaggggggcacaaaagagaggaatgggtagaaaagcaatgcgttagttgacttatacaaataaactagtgaatgcttctttaaataaagagcatccaaaatttatttcctggtcaatatactttctctgatttttattcatgaaaatgttttgatgtatagaatatgtgtccgatttcagagtatgtaaaccccgcccccctacatttatagcacacatttatgcttatacacaacacaagcataaaaccgaagttaccttgttgcatcattactgtttcaatgtagttgggataggaaggtttacgttaaacacaaaatgttcctcacatgtcacttgacttgaactgttcccatcagcaagaaaaattactgcaagaatgaaaggagttcacttttctctgtgactgttccaaagaagcggaagagcattttaagtttctccggtttccttgatcaatgtccctcaaacaacctaaaggacttaaaaaataagagaatgaaagatgagttaaaatgccttaatgattcagaaagctacatccatattgctaccaagtaacaaaaagaaataattgttccagaagacaattctgtaatgataagaactagaaaattggtttagattcaaatggcatctggagagaactgaaatcaactagaaccagccttctttaaagctgttcaaatcagacagcatttgctaccaaccacatttctccaacctatcttccaccacagagaaggcaccatctagccctcccagtcaattggggtcagtcagtgcacagctactttctcaatggctaataacatttataattcataatgttactacgtagtttgataagtaacaataacagtatctgaaaaaaatccttatctgagtgtttttgaggaaatgagagtggaggggaatgggggaaggacacaggcaggtataacaagatatcagggctcaacaatccttgttaattaaacaactagtttcttttacggactgaacgtttgtgccctctcaaaatgtatatgttgaatctttaatccctaatatagctaaatttggagacagggcctgtgaggaggtactaacagttaaatgaggtcatggggtgggactctaatctgatagaactggtgtcgttttaagacaaggtgagactacagtactctcccctttgccatgtgaggacaagatgccagccaacctataagccaggaagaaagccctcatcaggaaccaaagcagcagcaccctgatctacagcttctagcctccagaaccgtgagaaaattaagccacccagttctatggtattttattatggcagcccaagctgactaatagagatcctttgcacggtaaccaaaacagtgcctaccctgtgtcatctagttttcagcaacccggacttggattacttaattcagtttcctttgaaatgatgtggcattgttattggtaacatgtaattcagtttattctgaggaaagaaaagcagggctttaaaagcattatgacctgagtaagtagttcactaaaaaatttgtaacacaaaagcatgcttttgagtatgagatctagctttccaaaggcatttagaaattatagagactcagtggctatgaatgatgaggtactcttcatctgcctctagccatgtgctctgactttaaaaccagagacccttcaagtaaagtccacgttagtaagtgctgaaatgggtaattatttttcatgattacaacagcaagcttatgtaactacgctgagagggaaaagttaattccatgagaaaatcctattgagcgactgaaataaattaggaaaaggaaaggaaatgcagatttcaaatggttccgttttcaacgatctgaaatctgtattcaaggccaatttctggaaaaacaatttatgtgaatatttatttcctagaaagaatactaatgtaggctagtattttaaccaaatctaaaatcagatctcttttttaaaagtttaagacagcctgtgtgataatttttatttatttaaaagaatctgtcttctaaaatatttaatacacatactcttataatccagttgctagttgaaacaggatacaggttaaataagatagtatttctaaatggattctgaacggattaaaactcaataaaatggacattttattgagtgaatggagagatctaatccatctggcaagtcagttaagagagcttctgctgccatttttattgacatgtaatagtgtaataaactcacatgtaatactgtaaagctctgtaaaaaaattttaacctagcctatttgtttaaaggagatgttaacaattcatgctcccttgaaccacttcatttttgcttttaggacaggactgttcattaacacacacaatcaattactaaacacaattactgaaataaatattatcaagcagtaaccaaaaaattcaacgtaaggctatcatacccaaactccaatatccagaagccaatttaagtaacccatgcctccttggcgaaagtgtatggatattaccttttccttgtgatagtaaaacctatccattttcttacatcacccaagtatcagcttttacgcttctacaaataaagcagacaatgaacatactgtgtagaaatcttgagcccttaattaaaaggtactcacagagttgtatctaaatcattggctacaatgatctaaaacacacacacagttatagctaggtcatttgctacagtgatctaaaccacttcatttacatcttagtattaatcacaggacaaaaacgctaatattttcagaactacagccagtgttgctatctggcacaggcaacgtgtcttcaaaaccccatgatactatgtgtttgcccccaagtaaataggagggagatccaggcgccccttccaaaagcaacagcttagaggagagaaggaaaatcaaagatactgagacgattcattttagccaaaagcgaacctgccacccccaagagcaaaaaacaaaatctgaaaactaagatgtatgttattatatgttattcacagaacttatttgcaatatttttaaagaaaaaattacaaaaccgtgtttctcaaaatgttacaataaaattttatgtgtgtaaagtctatctattttacgtgtacatttgtgtgtgtgtaaaagagaggggattatgaataaggaagcgtatgtaccaaaacattagaagtagttatccttgggtaatgagattatgattttcactttcctctttataccttaatatatcatctccaaatttacaatcagaattcattataaagctattgcatttttatttatttatttattttgtgagacatggtctcactctgtcacccaggctagagagtgcagtggcgcaatttcagctcactgcaacctcggcctcccaggctcaagcggtcctcccacctgagcctcctgagtagctgagaccaatcaaagttaagttttcttcggtttaaagtaacttgttataattatgttgtttagcctcatggtaaccagaaaacaaaaatcaacagacactctaaacataaaaagcaaggaattaaaacactaccagaaaaaattacttcactacaaataaagacaggaagaaaggcaaagaggaaagagaagaaataaaaagagatcagaaagaaaagaggaagggagaaagaacaaaagaaaaagtagcaaaacaatcaagaaagtaaaaaatggcagtagtatgtttttatctataataatcttgaatgtaaattaaattaagacagagtggctgaatggattaaaagacccaattatgtcctgcctacaaggaactcagttcacctataaagacatacacagacaaagtcaagggatgataagagatattccatacaaacggaaacaaaaaaagcaggagtagctatacttagataaaatagcctttaactcaaaaaaagaaaaaataaagataattatataatgagaaagaagtaaacagccgttaagtgcatatgcaaccaacactcaagcacctaaatatagatgcaaatattaacaggctttaaaggacagagggactgcaatacaataatagagtacctcaacactccaccgtaatcaacaccccactatcgcgaacggacagatcatccagacaacaaaacatcatcagttaaactgtactctatacagaatggacctaacagacatttacacagcttttcactctgcaactgcacaatgctcattctactgagtggcacatcgattattctacaggacagactgtgttaggccaaaaaacaagtcacaacactttttttttttttttgaggtggagtctctgtctcccaggctggagtgcagtggcactatctcggctcactgcaagctccgcctcccgggttgacgccattctcctgcttcagcctccggaggagccggccaccacgcccggctaattttttgtatttttagtagagacggagtttcaccgtgttagccaggatggtctcgatctcctgacctcgtgatcccgcctcggtcacccaacacatttttaaaaactgaattcatatcaagtatcttttgtgaccacagtcgaatagtattaaaaatcaataacagatagaactttaaaaactgtacaaatacatggaaattaaaatacacacccatgaacaaccaataaaagaaacgaagaaaacacaagggaaattaaatatttattgaaacaagtaagaatagaaacacaacataacaaatcctgtgggatgcaccaaaggcaattctaagaggaaaagtgtatagctataaatgcctgcatcagaaaagtaggaagatctcaaatagcctgacagtacacctccagtaatgagaaaaacaggaacaatcaaatgctagaattcgcagaaaaaataccataaagattagagaagaaattttaaaaatagaaacaaaaaatacaaaaagtcaatgaaacaaaagctggggtgtttttaaaaaaaaatcaaaattgacgagttttaactagatgaagttagataagaaaaagaaaacaaagtcataaagaaggcattacaactggtaacccagaaatacgaagcattaagagattactaaaaacatcacaaacaaattgaaaaatctggaagtgaatacatttctagacacataacgaattcccaagatagaatgataaaaaataaaaataaaaaacctgaacagaccaataatgagtaatgcaattaaagcagtcataaaaagtctcctggcaaagaaaaacacaagaatcatggttttcctgctgaattaccaaacatttttaaaagagctaatatgtattttactcaaaatattccccataaaatgaagacgaagaaaggcttcgaaacttgttctatgaggacagcatgaccctggtacaaaaaccagaccagaacacaacacaaaaaggaaaccacaggcaaatatccctgatgaacagaggtgtaagaaatcctcagcaaaatacttgaaaattgcatttgacaacgcaataaaaagatcatctgccatgatcaagtggatttcattcatcccaggaatatgaggatgattcaataaacacaaataaataaatatgcaacatcacattcagcaaatcaacaacaaaaaccatataatcatttcagtagacgctgaaaaaattaaaagtcaacattccttcatgataaaaactcaacaacatgagtacagaaggaacatatctcagtgcaataaaggccatatatgacaaacccacagctaacataatcaataaggaaaagttaaaagctcttctcctctaagatctggaacaagtgtggctacttttacaccacttttgttcatcataatactggaagtcctagctagagcaattaggagaatgcaataaaaggcatccaaattggaaaaaaggagtcaaattgtctgtttccaggtgacatgaacatatatagagagaaccctaaagattccacaaaaaacctactagaaataataaattagtcaagttccaagatacagtatcaaaatataaaaatgaatactacacccatgcaccaatagtgaaatatctaagaaagaaatcaagaaagctatttcattaccaaaaaaaaaaatgatatctaggaataaacttaaccaaaaaggcaagagatcccaaaatgaaaacttcataaaacatagatgaaagatactaaagcagacacaagtaaatggaaagatatcccatctctatgcactagaagaatgttaaaatatgtgtatcacccaatgtgatctacagaatcaatgcaatccatgttcaattacaagacattcttcactgaaatagaaaaagaatcttaaaattcacatggaagttcaaaatacctcagatagacaaaagaatgtggaataaaaagaaaagctggaggcatcacactacctgatttcaaaatatactacaaatttatagtaaggatggtactatcaaaacagcatggtactatcaataaaaggggcgggggagagacaagagagatgaacgaatgagacagacagacatagacaagtgaaacagaatagagaaatcataaataaattcacgcgtttacggtcaattcatttttaacaaaggccccaagaacacaccttcgggaaagacaatctcttcaataaactgtactaggaaaacccaacacccacatgtacaaggatacatctaggccattaccttaccatatacaaaaatctactcaaaataaagatttaaatacaggacctgaaactatgaaactaccagagaagaaaacataggataaatgcttcatgaaattggttaggacaaggaattttcaaatagacatcaaaagcacaagcaacgaaagcaaagatgtaattacattaaacttaaaaccttttccaaagcagaggaagcaatcagtataatgaagacagaacccgagaatggaagaaagtctttgcaaactatgcatcaggcaagaggttaatacacaaaatatctaaagaactcaaactactcaaaagtgaaaatacaaataatcttatttttaaaaatccacccaaaacttttgtcccccaccatttccccaccttcttttcccgaccgcatttcgccctctccctctcaccaccctttctcttcctccatctacccccaaacgttttcaccgttttctccccaccatcatttcgttttctccccgccccaccccgcgtcatttcgcaaagccttctctattctcccgctcaccacgcttttccccaaccatctacccaaacactttctcccgttttttcccaccgtattttcccccttctccctggccaccctcttttttccccctcctgctgtcatcatgcccttttcctcctccatctaagcaaaaacatttcccccccgtcttttcccaaagccttttccccactcctgctgctcaccaccctcttttccccctttatctacccaaaaactgttttcctcattgtctttcctcctgctcctccttgccactctttcccttctccatctacccaaaaacatttccccaccatcttttctcgaagccttctccccactcctgctcacctccctcttcccccatctaccccccaaaatttccccatattttcacaaagtctgccccctcttcccactcgtcctcttctctcccctatcctgcttgccacccttttttttgccctgcatctatcccaaactattttcccgtctttttcccaaccttctttccctgctcccttctcgccaccctctttctcctccttgtcaccctctttccctcctccatctacccaaacactttttacctaccatcttttctccaccatctttcttttctgccactgttttttcgcaaaaccttgtcttcctcccgctagttaccctctttttccttctcccacttgctatcttcttctgctcctctatctacccaaaaacttctctccccactgtcttttcacaaaaccctctctccctactgctcgcccatttcccccacctcaccactctctcctctccccaattgccaccatcttttcccccttcatccacccataaacttcctatccaccgtctttctgcaaaaccttccctcactcccgctccacaacccgtctttccacctccgtctacccaaaaccttttttccccaccatcttttccccatcgtctttttgcaatgccttctcctcctcgctatccttttttccctttggcaataaccaaactctttacccacccctctatctatcccaaaactattttcctcttcctacccttccagccgcgctgcaatcgcaatctccactgccaccaccaaccatagcgaggcgagctgcgcctctgtgccgtgtctcaagcctccagcatacggccggtgactccttttcctggtcctctaagctgggcactgagcagctcaacagtaaaacacccaaccctaaaaaaaaaaaaaaaaaaaaaaaccgtaacggctcttcagcatcatttatatacggaggttatgcgcatgccggttcctagacttcatgttctgattgcataagagcaagtcttaagataaccaatcacagcatgaaaataaagtccaatcagagtaggcctagaggtttttctctcatccaatcagaacatgtagtccaggatccgtaacttcagtatataaagcatgctgaggaagtggtgcgtcatttttgggtcttctgtgtcggtgtgtccagctgctaggtacctgggttagagaactagaagggtccattagttttcaccgcctggagcctggagcctggagcctggggcgctgcctccctgttggtggtgttggtgacggagcggtaggagggaggctagcagcaggagcttctcctgccgggctggaagacgaggagaaggaagagacaccgctgcatgctggaggctggagccagagcctgcgcctccgtggcttacctcgctgcagttggtggtgacatcagagaccacagctcggctacagtggtagcaatgtggttgcagtgagccaagattgcatcactgctctgcagcctggcgacagagcaagacaccatcttaaaaaaaaaaaattgacccagtgttttgcatgtttcagaaaaacaaatgataccattatttaatatgctgcagtaactagaagcctacttataaagttggtggcaaataagtcattggtatatgttaacttcctataatcacttacatgttcctaagagtcactttgtgtatttatataagaaggtcagcatgtaaatgagtatagatagagaaactttttgttgaaaagtaagaaagcttgtctcccttttcctagttatgaaggaaccaccaccacaacaaaataaagcatatactttgtttataaccctgaatcatgatttatggccagattatcctagcatccaactgcctaccttggcatttatcagttgaaatgagtccagagaaaggaattattttttatatatctgctgctcttgaaggagaaaccttctttagaggtcacttgtaagaacaggttcccaaatcccctatatccaaggcactctgggctgcctgggaactctacaaatcacagttttgaggggttcacttttctggttgaaatttatcatagtttatatgatgaaaggatgacaggtagatattctttaagagttgaggatgtgttatgttaccaaggattgtaaatatttaatgagaaaatgagttagagtttcaataatattgatgggacctattatcactcactttcatctaaagctcagtgttacttcaaagcataaaatcaagcaaacatcccatgattaatttagtttcttacactgctgtgctttgtgtttcattgaattcagagtatgcctgtgtacggtccctgggaacactgtatgaaaggatttttaaagtagtctgttctgatactggtttgtcaatgaaacttttcaaaaaggttagttgaatatcacttagtgttctttatgtgaccctcttgggtctccttcccagtgccaaattcccccatctcaacctcatttggacatcctatattaagaaaaaacaaagcaggtactcatcagcaggaacggaatcctattctcttgacagaattcccgtgatctataacctgctggataaatagttcaaatgctgtatctctgttcctattcctagactttctggcacctattacccttcaagtccatgtgtcttccagtaggttgcagtgctctccccaggagatggcagctacctagatttgtatgttacagaggtggtcgtgtgccttctctacctctctcctatgttcccatgtaacctaaccacacaggccataatcagctccaccctaggaaacataacattggtacacctgtcccttgaagttgtccttagagagaatggtctgaaaacaaagggagattaaaggtcttttctgtttcagggaaagtatagttctgtcagtggatttctggttaaaagacacagaagaaggaaaaaagacactcatctgtaggaactcagtttagccaatgtgacttccacttggaagcatttttcctctcctcttcaagcccaactctagggaatgtcctgtgcaaaaatatcagtgtaggcgcatctctttgcggaactgagttgctctgctttcagtttcctctctccagtgcccccaagctcctgcctggcttcttctgctgttcaacccaggatcccatgctctaggacagccttctcaccatctttcttcagctcttaattcaaaagtcccacttccagttcatgctcagagaaaaagcaagtagacctaatctttattagaatgtgaatttctagacaatagtactctctttggcttacttcactgccctacgtgctgaactttcagataatataaggaagagaaaaaagtctagatgttggagagggagtcggtttcattttatacgattcagcctaatgggctttcattgctaacattaggggttacagttgaaccagccaactcaggaggaaattcagaacctggattcttatagtgatagtggaaaacaaattcatggttaagatttgaatgtgaattttaaaataaatcatagtattttaaaaaaccattttttccttattaaatatgtaactttggaaaagttacttaaccagttcataatagtacctattttatagggctgctgtggggatttaatgagatcatttatggaaagcacatggcactgtgccacactcataataagtactcattcagtgttggccacaattctcaccagccttgttctctgtcctcaggagatgatgaccataattggaaaattgcccatgtggtactcaaagaggaacaggaatttcgctaacttttccagggcacaaaaggcgaccctcggaactcaactgggggaatttacctggatgacatcactcttgacagaaaccccctgccccacaggggtctggacagtccagaatttctcccaggtccttgagaacaccagcgaaggggacaagcttcagagccctcgattctacaattcagagggatgcggttttgggttaactttatacccccatggcagagaaagctctggctatttgagacttgctttttacatgtgcagtggggagaatgatgctatcctggagtggccggtagaaaacagacaggtgataattaccatcttcgaccaggacctgatgtcaggaacaggatgtccttaagtttggtgttcactacctccaagttgcacatatctccaggtgggtggtgttggcataaataagaactgcccctcgaaccagagaggcccacagatgtgattctgtggtgcaagaaagagtaacgttctcctcacattttccgcctgggaataccgataacataggcgtgttggagtttcaagttaagattttcaatgccatcacatcctccttccctttcctaaattcactcatcaaacatctgttgagggcttaccatgtgccaaactctgtgctaggtacttacaatacaagtgaatcaggtgatccctgcctcattgatctcattgtgattgaggaaacagatactgctaatcatttatcaaatactcggaacttgctaggctctgtgcagagctaatgtacttactcctaaaatagcactcaatatcactatgttcatgaaataaacttacatcagtaaagaaatgggaaaactatttttttttttttttgagatggagtctcgctctgtcacccaggctggaatgtaatggcgcaatcttggctcactgcaacctccacctcccaggttcaagcaattctcctattgcagactcccgagtagagaaggggtttcaccctgttgcccaggctggtcttgaactcctgagctcaggcaatcaacttgcctcagccttccaaagtgctaggattacagacatgaaccaccacacctggcactatttttttttttcaaaagagaagacctaagcctcagaagaaagaagccatagctgtccctctcttttcattaaaaaagtcacgcagtagcagacaactgatcactcagagctgtgattctctgcttctcccatctttcaattctgaattgcaattctcctggaaagagtaaatagcttaatttttttccaacactttttttatttttatttttatttatttatttttttctgattcacaaagccctgtatcctcataaaagacaaactggaaagtgaagtctaaagaggtaatgtgattttatgttacctacaattttgcagcgacaaatgacactgtcatctgggacaggccgtccagggtgggaacctatcatgctgactgtaattgttttagaagcattgactttggctggagtggtttcatctcccaccaaatgctgaaaaggaggagtttcctgaaaaatgatgacctcatcatgtttgtggactttgaaggtacttttcttggtcttcctgagtaaataatcctatgctcttggcactctactgattttatcctgattttaaagcacacatggagggtggggatgaggttaaaaaaaatgtgttgtaggagaaccacattttcttcaattggtcaaggactcacatctttattttaactgtccctgaaagaaactgaaattttagtgtcatctttttgaaaattttatcagaggtaacagttcactgatttcaatttagtttccatcagtctatccatgctaactttatgcttcattttgcaaattcaataaataaaaatgtgactggattactttaaaataaaactagctagtaccgtgggaatcagctggattcaaagccacttttccatgtcactgggggtgacatatcactagagatagaagcaggctggggaactttcaccagaagtgggagttcgctgtagtcagttactaatcctggatcttcctcgtgaccctctatttcctgaagatatcacccacctcagccagactgaagttcccactaaaggcaaaagactgagcccccaaggcctcattctccaaggccaggagcagcaggtctccaaagaaggttcaggaaaggccatgttagaggaagctgtacctgtcagcctcagccaggggcagcccggctgacagaagccgtcagtgaagaacacaggccccctggaggaccataactggccacagtacttcagagacccatgtgacccaaacccttgccaaaatgatggcatctgtgtgaacctgaagcgggtggcgaggtgcaggtaggctctgtggccggggagacaggcaggccagcagacctgggccgtgtgcatgcttatgcctggtaaaggctgctgtttgcagagtagggcgaagactacctcagatggtcagctggatgcggttttccttgactctacaaaggtgtgccctggattcatgggcttacgctgccaggacagaggcgtcccaggtctccttgtctcttgactttcaccccttttcctcctctggggtattgtcaacagcatcttggatgttgttggaatttctaactctaacaacatccaagatggcttctagcctagggactttctactccatgacagtgggtctcaagaccaagcttaaatctttgctgactacacagatgttattattagctcctaatgattattagttatacagtctgtcatttacactgcactattattaaagttatgttttcaataatagtagtaagaacacctgatatttctgaccccttgttatgcatcatgtggtctcctgagcatcttacacgcatgatctaaattcattctcactgccacctgtgacataagggctctccttatccccatttggtgtatcaagaagttgaggcttagaaaggttaagtaatttatctaaaatgtacccagatggaaaatgctgaagctgggacttgcatctaggtctgtctggcagcacagtttgctatatttaatgtttaaatattaaaaagcagtacagtttgctatatttaaatttgaatatttaaaaagaactttaatagttctttttataatgtttgcttgcataaaaccctaaaaactgtttcacaaaaggaggtatgtgatgacagaagcaacagttccatttgaacagtagcagatgtaggagctattctgcctacctcaaaaatttacattacttctgagttctttttagtctccttttttttctttttgtagcttttgctttgaaataattttagacttacagataccttgcgaaaatactacagaggctttctctataccattcaccctgctttccgtaatgttggcatattacacaaaccgtagtacaattagcatagccaagaaatgaacattggtagaatgctagtaaataaattacaggccttattcggctcttctcagttctcccactaatgttctttttctatttcaggatccaattccggatctcacgttacatttagtttttatgtctcctgtctcctaatcccctccaatctgggacaattactcagttctttcttgtctttcattaccttgacacttttgaagattactggttagggatttttttttggttcatcttgttctctcatgattaaattgaggtttcacatttgtggcaagattagtaaatatgtgctgtgccttcttgttgcatcatgtgagcaggtacatgatgccgatacatgtcattactggtgatgtcaaccttcatcatctggccaacagcatgtccaccaggcctctccactgaagagttaccatttctccctcggtaattgatacatatcttgggagagatagttcaagaccattgagacatcctgcttttcctcaaatcctcacatgctaatttcagcatctattgatacaacctgctgcaatattcaccactgggatcttctaatgttgatttcctatgtccttcacattcattaattagaattcttctgtaaagaagaatggccccttcaccccgttaatttgtttatgtgattatttatgtatatcacaaaggaatcataaacatttattttattcagtgggctctgttgcaatgatttcataatttattttgttgcttctattgtcccagctttggcctttgggagctcttccaggttggctcctgtgatctttcaacatcagattttatgaacacaatgttactttctggcaccatagcatgctctaggctcatcttttatatttcctgccccacccatagaatcaatcactcttccaagaagccctctggctccttttactggggaaggcccatctgtttctgggctccaaagccatgggtcttcatatctttgcctgacaggtccttagatgccagattccattgtgtgcccccaacacgcttcatccttcccaggctaagggaggccagggttgccacttgtatgtcagcctctactcagccaaactattcctctcctagaaacctgcagctgagagttggcagaataagtttttctaagataacagtaggggatattacgaagttgtgtttggaggggactgggtcagaaaaaaaatgaaataaacttgctattactcactgatttctaagaagtcaattctcaggatagagatgaggacttggaaggtaaaatcattcaggattagtaaaagaaaatgctgacttctttttttttttttttttttttttgagacacagttttgctcttgtcacccaggctggagtgcaatggcacaatttcagctcactgcaacttcgacctcccgggttcaagcaattctcctgcctcagcctcccgagtagctgggattacaggtgcccaccaccatgtctggctatttttgttgttgttgttatttttaatagagatgagaccatgttggccagtctggtttcgccattttggccaggctggtctcaaactcctgacctcaggtgatccacctggcctcccaaagtgctgggattacaggcgtgtgccaccatgcccagccagaaaatgctgacttctgattgtttcactctgccttgtagaattctgctgagtagaccttctagtgggaatgtttgaaacaaaggctggaatttttacaaaggtatggatgagacactacaagttatatgccttggttatgagattaattcgtctttataccagataacattaagaaacaaaactaagggctggccattatgtgcttactctgtgtcaaataccttgataggtacaatgtcctcattatctcaggtgaacttcagggcaaccttgtgagatagtgacagtacacactaaccttacagtaacattttatttaatattatttagacgttttcaagctaccactgatgctctaagtcagactgtatctggggaatttcctttgtagcttgtattcttagccagtgtcaggcaatgtattcctttaagtgtctcagaccatcctcctgaatcctaggtggctgagaagcctggatctggaggcatacctcttgggattagatttcaagtgtgaaatgcttactaacaatgggaccttgagcaaattatttaaccttcctgtaagatgaagatgatgagaatggccaagtaatagcctccacctcaaaagttgttgaagggttaaattagttggtccatatacagcacttgaaatgggaccaggcaccacgtggacctgctcagtgagcgtttgccatttttattgctgtggagatgagtgttgctaggaggcacctgaggcctgggagttcccacactctcttcatgtccttttccctcaggtgcatctctggacatgctttcttctaaatgggagcgctgtcaggccatgcagttgcacggcagcgtcctgggcatggtgattggaggcacggctggtgtgatcttcttgaccttctccatcattgccatcctttcccaaaggccaaggaagtgacctgcctgttggcattggccagaccacagcagcacctcctccatgcaggccttaccttccaatggtcagtgcagtttggggcagcttttttgtcagccttgctttggataggatctccaaggtctaaggcctccagccccatgtgtgacccttgtcatctttctgccccacataattctgttactctgctatgtgctcctaatgtatctagtgtgtcctgtgacaacattcatcatacttcattgtaaaccacttgtttgattgactgtctttcctatagactgtaagccccatgagggcaggcacatgttgttattgaccatgctggccacgtgcctagatgcatggctggcacattgtgggcactcaacaatggttgaatgaataaaacaataaatgaatgaataagatatagaaactctcatttatattgcagatcaaatatatattatgaaattcttatgttgaatatgttagaatcaaatactcatttttcattagacacagtactgtcattactcttttaagatcttgttaaagatttcaaataaaggtacttccaggcaggctggcttcacagcatttgctttcctctgagattctaagagaagccctttaataaatttaataaatattgagttagcaccttctttgtatctggtattgtatgtacgtgtgggtgtgcatgtgtgtgttgaaggttgggggtgttcaaaagctctttcccagatcttttaagtttaacagtatattttatagctatttatgtacaacattatcatattaacaaacagaaggtatcagagaactttaaagaagtatttttagatatgctttctttccatagttcctaaggagataaaaatctagctggggcaaggaagttccaagatagatcaagtgaaaaaaaaaaaaaaaaaaaaaaaaagctaaagtttctatacccaatcagcaatgagtcagctcaggaaatttaacaaacaaaaatattttaaggattctgagtggtcctttaagttataaggtttcctaagtagagactttatgacaattttgtagagttaaaatgcactggaaacaaaatgagagattaacaagagtttctttaatgcaaaggtatgagaacaatttgtagcaagtgaaaacagcacccctgagggcaatacctctcaaacttgaggtgcatctgtatcccagggaggactgattaaaacagattacagggccccacactttacaaacctccactttcagtagagcctccaggtccctcccaagagcttccgtaagtcaccacaacccaagaggaccagggagattccctcatgcagatgttcccagaccatgcatgtgatggcatgtggagggcttcccaccttgacatcttcctgtcctctgtagaaactgggtcagtagatctagggtgagatctaagaatgtacattcttaaatgtgccaggatctaacaaggtataagaatgtgccagaatctaataagttctcaggccatgctgctactgctactgactcccccacaacccccacctcacagacaccttgagaaccactgctctagtggatagaaaacaagtctggaagccaagcatcctggctgcaggcttggattgcccatccagctggctgggtaattttagtaagaaatcatttaagctcttgatcttagtttactaacttgtcaaatggaaataatagctgactatctccttccacatgactttactacttacagagtagcagagtaatacaatgggataatgaatatgaacctatcttagagtttaatatgtatgaaaatattactattcaatgttcagactagataggaagctatcctgtcaccagcccagttgtattatctccaaagtccagattggaaatggattccagctttgtttctcgctgtgcttcacagtcctgcaaaccctccactaacctcatagttaggcctaaagaaagctatgcccttaacactctgctgagtatctgacctcagaagtgaactctaggctttgttgctgctgctgctgttattgtcctttggttttattaaaaggaacatgctgtggtctgtctcacatggaaaggtccctagcccaaaccaatgacaacatttcttaaatatatgagtttctctctggaagaagcagaagctcaaatttcaaagataacctagtattttcatctagtactgcaaattaaaactgctaggtcaaaataatgataaggaggtaccagaatgagggtaaagcattttgatatttatttctctctagattctcaaccagtaccatgcctactatctatctttatcacttttggtgattaatggtcacctcagttgattaatgatctggctcaccataaatctgacatggtattcagcttttctttgagcccaaaccctcaatcattccaggaggactagcagatactttattcttttgaggtgttgggatggtgatggcaaagtgggcatgtaggatggggagtgggtagaaattaagcatttcataatctctaggcagtatggaatttgggatttagatgagcaacatgaaaaatgtgggaaatcctccctgaatctgagtgtctgacttctttaatcttacatagtgggaataagtcatagtggcttgaaattttgaaaatgtctcatgcttcccacaccatatccttgatacatccccatctgcatcctttccttctgtgaactgagctgagccaatctggccattcacaaatgtcaggttctttcagtaatatctggagcctctgataattagaagtggatgggaactctaaccccctctctgattatgttaaaatgaatcaagatttgaactaaattctgctacacattcatatttgttaaccattgttgtgggaagtcagggactctgaacggagggaccagctggagctgcggcagaagaacatcagttgtgaagatttcatggccatgtatcagttcccaaaattgctacttttataatttcttacgcctgtctttactgcagcctctgaacataaattgtgaagatttcatggacatttatcacttccctaataatagtcttataatttcttatgtctgtctttactctcttaatcccattatcttcataagctgagaatgtatgtcacctcaggaccactattgtacaaatagattgtaaaacatgtgtgtttgaacaatgtgaaatcagtgcaccttgaaaaagaacagaataacagcgattttcagggaacaagggaagataaccataaggtctgactgcctgcagggtcaggcagaatagaactgtatttttcttcttgcagagagcatataaacagatgtgcaagtaggagagatattgctgaattcttttcccagcaaggaataccttggggaaggaatgcattcctggggggaggtctataaatggccgctctggaagtgtctgtcttatgtggttgagatgaggactgaaatattccctggtctcctgcagtaccctcaggcttactaggattggaaaattccagcctggtaaattttggtcaaactggttctctgctctcgaaccctgttttctgttaagatgtttattaagacagtatgtgcacagtgggacatagatccttatcagtaattctaattttgcctttgccttgtgatctttattgccctttgaagcatgtgatctttgtgaccttctctttgtttgtacaccccctccgcttttaaaatcctaataaaaacttactggttttgtggctcaggggacataacggacctcccaatatgtgatgttacccccagaggcccagctgtaaaattcctcctttgtgctctttctctttatttctcagaccagccaacacttagggaaaatagaaagaacttgcattgaaatattggagtctggttcccccgataaaccaacaaacccacaaatagccatccaacctgttttgtatgtgtagggaagtctctgctctgtccttttaagtgctccagcaccaagcctcttggattaaaggttcattctacacacatgcattcaaataatctgaaggccaggatcagtcaactctctaccctagggtttctgaacctcagccctggtgatattttgagctggatattcttttctgtgagggctgttctctgcattgtgatatgtttagtggcatccctggcctctacttactttatgctcatagcacacttccccagtagtgacaatcccaaatctctaagacattgacaaatgtcccccaaggggcaaaatcattactgattgggaatcactgctctagttggatgagccaatgaaaacttgtattaagtgagtgaaaactaggaccaaatagagttctagtcaaaggttctaccccaaaagttagttcactgggcctgccaaagtattgtacctatagctatcttgataattgtatttaaccaatgcaaaaattattttaagcatcctttatactaataacaaaccctctggtatagcttgctatagaaatatttaaagttttgcaacagatatttctccagtagagacttttgattaggatctttcaaatactaactaactgctattggagtgtgtattccttttcagaatactttgcatactatttaacctcccccagggtgtggattatagtccccctgcaggctgtatacagtgtaatacctatatggagacatttacaagcaaattacagatgatctcacaccttcccttcttgagctcctcctttctcatgaattatatcatctgttttatggcttgatgaaatttttagagattctgaagtccacctcttgtatttgggtaaactgaggcaattctggagaggctaagtgccttaggcaggtcacagagccacttaatagcagaatctattattcttgtttgactacagaaaaccttaataagattagaggtttggaaggtgctataaaatataggcaaatctatattgaacactatgtaaaggtcttttttacttggtttcccttattagggatatcaggtttatggatgatttgtcacctactcaaatttctatatgtttataaatatggctaaaacatctttcttatgccaattttaatataagtatgtttttcaaaagtctctaagcaaagaaaagtttgaaaagatttatagttatcctgtagctgtgagtgtcatttagcagactcttgaaaaccctaatgaatgggggatgggagataatggagtcaggtgccagtgacctctaatgagtactgatgtgaaaaaatatgataggaaatatttgatatgggtaaggcagcctaacaggatgtgtgtgtgtgtgtgtgtgtgtgtgtgtgtgtaagagttgcagctaacagtgatatcagagtaaagacaagacccatctctctttgccttccacaattttaccaaggactagtcctggaatcccagaatggattgagacatgggcctcatctgggtcacagcatccctcagggcctagacaaatttaggacaaattgacccatgtgtggctcaccagctcaatgaaaatcattaaaaacatttaaagatcctatctggtcaagagaataaagggagaatagaaaaatggggtcataagaaaggtatgagaagagagcaggaggcagaggagatgttcagatatcagcccccaacaaaaatggtcaccaacatccattcttcttttctcagtaatagaatccccaaactccaactggtcaaatggctactcagagtctagtttaccttctcctgcttcctttgcaggtagatgggtgatatggtttgtctctgtgtccccacccaaatctcatcttgaattgtaatccccacgtgtggagggagggaactggtgagaggttattggatcatgggggtggcttcccccatgctgttcttgtgatagtgagtgagttctcatgaaagctgatggttttaaagtgtggcacacctccttgttctctcacttttcaagtcttgctaccatgtaagacgtgccttgcttccgctttgctttccactatgattgtaagtttcctgaggcttccccagccttgcagaattgctagtcaattaaacctctttcctttataaattacccagtctcaggtagttctttatagcagcgtgaaagcagactgatacagtgaggtagtgtgatcaaattcaggccagtggaatggaagaaggaatgttgcatgtgagcttctgggaacctttcctaaaggagtcttggtgcacacctgtagtcccttcttctatcctaatgactgataaggggatgtaatggccagagtgagagctgccaaatggggccacgtggtgaccttggcaaaagcagattaaaaaaatagaaagtatctggatttctgaggactgcaccgagccaggctgccacaccagtcttgggctgcttatctgtgttagagaaataaacttctactttaagtcgctattattttgaatgtctggcattcacagaaaacatgatcctaatggatataattatttctatggggccagcacatggctcagactaagccaatcatgataccctgtactgccacatatacctgaacatttggagaagaaaagggttagtcttctcaatctatcggtctgtggacctcataaattcctctccttgaagatctaccttggaatgaaataaatacacaaagagaggcaacaacacaaaaggaagagccagaactctgagaacactgtttgggcacctgaatctagctgtacctgaaggtgtaccaatctactatctttcccagttacgtggtaagtgcccacttttgcttaaactaatttgattgtggttctgttacctgtaactgagaaagccttaattaacaccactgttatagtgcataattggctcatttgtaaagaaaagaaataatgaaattagtttgaagattaaataaaattatgtaatatgtaagattaccaaaactgatttgaaatgcagacatggggtagttaaccaggctcacacacttgttatgtgaattactcacccattctggcttcataatgagcacgatttaaactcaaaccttgataaagttatgatttaggatgtcacgtacctttgacgttactctcaaaagctcttaaccatgaattaaaagtgacaatgtgaaaggcatatgtagtttgattctgaatagaactggcatctaaatctgagttctgtcaagatctatcaagaattctgagtgttggatattatttagacacataggaagaaagtatgacttctcagaaatgaagtgtaattctgaggctgtgtttaaatatatcaggaggagaattgaaacatttgctctaataaatttggctaagtcatgatgcatgatgtatatatgtgtgtatgatatatatctactatagtttttatgcacacacggtaagatgcaaaataataaaggctaactttattcagcaataattgcaagccagatatgattttgtaggctttataagaattttacaacaacccatggagcatgtaccattattatttcctttcacatagtgtaaattgaggcagaaagagttattttaccaacagtcaaactaagaagtggtggacctacaactgaaaagcacacagtttggctctagaaccaatgctgttaaccaccataccacatttgccaaactggctgtcaatcaatgctgaagaacagcccaatacccctgtccatgcaaaatgaagcagagaatgcaaagcattcaagtagcaaatcagctgctgtttcagtctgcatatcagaaggaaaatcatgacttagctaaacgtattaggacaaatgtcccaattctccacttgatatgtttaaacatagcctcagaatcacgcttcatttctgggaagccatattgccttcctacatgtctaaatgccatccaacacgccgagaattcttgatagatctgagacgaaaataaaaacaacactggtgattgagaccttacaagaagctcacttgactgaagactcaagctgggggggtccactagataactaagttgagatctactttcaataaagcagcacagcaggaattctttgatgtttcaccagagacttaaaaaggaagtaggcgcactctgaagtttgcccagaacattggtcattatgtcctgggctgccccaaggtagaattataaagtgagatgaagcttggggaagccttaactcctccaacctctctgtcactgttgttctccctctcattttttgcatttgaaactcttcctgctacggaagcctacttttaagcaagtaactggcatcaggttgcatagagaagcaatataaggtggtggatacatgcccatgttctaggtcagacactgcatttagatcctgattctactggtcctcagctgtgtgactgtgggcaagttatttacctctctgtgcttagctttttcctctaaaaatgcaaagaaaaagaatatttagttacttttggtttgctatagagtttaaatgagattatacgcataaaaatcttagaacagcagcaggtacacagaaagggctcaaaaaatgttggttaatatagttatatagttaccagccattttcattcgagggtaaatttaagttactgtgtttctcacccagaggtgtatttgcataccttttctctccttgagattaacctgagattaaccttcttaactttatctgtctttgagatttctgtttttgtaaaaggaatgtccaacatgaagaagaaggtgtgagagctattccgagggtataggagcaacaggccaaggtgcgtgacatccccccaaactgggaagctgtctgcctcattactgaaggccagttcagcttgtccctctacaccaaggaccaaccctgctggcagttggccctgttgacttctcctgggtcttctcgggtcacacgttagcaatgtgtgctcagaggataggaacttgccatccagcctcagctgctggctggactgtcagattgccctgggatagctgcagattcatctgcagattcatgatggattgaaaatgaaactccaggccagcagtggctttcaatggatgaattaggaaagggaataggaccacctatgttaatccttttgcagctgccttgatggaaaaagtattgggttaacatgaaacatggaaggcacccatttttcttcctcaaacgaccttccagcagcctatctggaatgggtgaaccagatcttttctggggctttcagctttgctgttagtgccataaatgagattcagtcagtaagagggggacagagaaaggaaggagctatctcagcgagtatgcctcagaaatgtatgcctgcctgcagatgtgctatgcacacttgtaaaccagtctctgagacaggtctcaatcaacttagaagtttattttaccaaggttaagaacatgcctggaataatggaacacacaatcacagagacagcctgtggtctgtgtctttccgcaaagatattttgaaggtttcagtatttaaaggggaaaagtggaggcgaaagagggaaggtatggcaacatggcataatccatgcattgcaggagaaaaggagcaggtaggaaaatagtcagtgatgtattcatctcagtaaatcggtactttacataaaaggtgaacctagtgtagctctctgtggagatatctggcctttcatctgttagctatttgcttagcaatagaaggaaaaggctgtttcttgcatggctcagcttccatcttaattttttcctttttgcatagtgattgggggcccgaaatttcctttgcctttcacacactgaaacgacgtgactgggatttccctccctccacagtcctacgtggctttctgactaccctttcccctgtaaggatcataatatgaaagttaggaggctggagtgaaagagatttttttcatttctggtttctgttatccactatgccttgaccttcgctctgcccatatgatcaaatgacttcctgaacgtagcccactgggcgcgtcatccgcgggactgactctgcctcccacgggcttcctgaggccggaccgccgcggggacgcctcctctcacgcccaccaggggcgcgcgagcctcaggagacgccagcaggggttgcggagctgcggtgctggaagccagctgtcactccaacccagctggagattcctgtcgggaatgcttgggataggacagctgtgagggagcccctggggcataggaaaaccctcacagttccagaaaaaaacagaaaacgcatgcacagtttttctcggttaatcaaagtcaaattccttttcccacaactgctggggtgccagctggctggcaggatggaagaaccaggatggcaccaatcaaaatccgaaaaaggcagggtccaaagtcattcctgggttttgttgtttaatgtcatcggaagtgggccgtgacagcaatctgcccaccacttgcccattcaggtcctcttgcctttcatactgagaataaagccatttttccccccgggctcctgggtttgttctgtttaggcttcaatagtcaccggcatccttcacatggctctgcatgacagaataaaaaccctggggtgggaacaggctcatgtatctcctaaccatgccaccatgtgtgcagagggacctgtcatggacactggtggcctttcaacttcatttcaaagtttacaggtaaaaggggaaaaatgggtgtgtataaaatcatttaagaataatcccagcactttgagaggccgaagcgggtggatcatgaggtcaggagatcgagaccatcctggctaacacggtgaaaccccgtctctactaaaaatacaaaaaaaaaaaaaaaaaaaaaaattagccgggcgtggtagcgggcgcctgtagtcccagctactccggaggctgaggcaggagaatggcgtgaaccctggaggcggagcttgcagtgagccgagatggcgccactgcactccagcctgggggacagagtgagactccgtctcaaaaaaaaaaaaaaagaatagacaggacggttgtgtctgaatcataggacaccacgaccaaggcccccacgcccaccccggacacgtacagatgatatttggagatcagaacttgtgtctggcatagagcggacttcgggagttgcccatctcccctcttttcttcttctgtccactaacagtgggaaacttggtttccgtctagaatgtgctagaggataaatagagccctcacatcctttatattaatctataggacatgagggctctattttcagctgtcaatgaaaatttcaagccatcctcacacaaatgttggaacaggcatctgtttgttcgccagacaactggttctgaaaactttacttcaaggacccttgtttaaaccttctataacgtgctggatctttgcacacggcttgggagtgcggatggtgtgagggaagccatcagacctgccagccagttgagctcaggggcgagctgccggcctcccccatacctggaagatggaaaggatcgttcgctgtttggagaatagagctgcattctgggtgacatgcagaagcctgagaggcagcagcaccacattgcaagaaggcaaacaattgctacagagacagtgttgcgggaagtcagggaccccaaatggagggaccggctgaagccatggcagaagaacgtggattgtgaagattttatggacatttattagttccccaaattaatacttttgtaatttcttatgcctgtctttactgcaatctctaaacataaattgtaaagatttcatggacacttatcacttccccaatcaatacccttttaatttcctattcctgtctttactttaatctcttaatcctgtcagttgaggaggatgtatatcgttctaggaccttgtaataattgtgttaactacacaaattgtacagcatgtgtgtctgagcaatacgaaacgtgggcaccctgaaaaaagaagaggataacagcaattgttcagggaataagagagataaccttaaactctgaccgccggtgagccgggcagaacagagccatatttctcttctttcaaaagcaaatgggagaaatatcgctgaattctttttttcagcacagaacgtccctgagaaagagaatgcgcacctaggggtaggtctctgaactggcccccccagggcgtacctgtctcttatggtcgagattgcagaggtgaaataaactccagtctcccatagcgctcccaggcttattaggaagaggaaattcccacctaataaattttggtcagaccggttgatctcaaaacgctgcctcctgataagatgttatcaatgacaatggtgcccgaaacttcattagcaattttaatttcgcctccatcctgtggtcctgtgatctcgccctgcctccacttgccttgtgatattctattaccctgttaagtacttgatgtctgtcacccacacctatttgcacactccctccccttttgaaaatccctaataaaaacttgctggtttttgtggcttgtggggcatcatagatcctaccaatgtgtgatgtctccccccggacgcccagctttaaaatttctctcttttgtactctgtccttttatttctcaagccagtcgacacttaggaaaatagaaaagaacctacgtgattatcggggcaggtcccccgataagacagctcacgagatctcattagatatttcattgttatagtatggaaaggaagcatatttgtgtgctggtatacatgatgtgattttaaatcccaagtgataattttagaaaccaacagaacctaatattaaagctaaactactgtcctcttgaaatgatgagatgctattccggttgcccttttaaaaacactatcaagaggtaagttccctgtaagttccaccttcattttgtacacttaaagaatcagtcttttactggcctgggtcactgggttttctcttttggatgaggagggcttatttgacttcaccatcacatggcacaaaataaacgcattccacctacctggcatttctaggaccacctatttctttttttcttcaaatgattgtgacttcctgctccattcacctcaataactcacccacacgtcctttctatacttactaattactgtaatctttctcatctccatgtaacttttttttttttctgaagcattccaacatggatctctttgaaattctctatacaaaccacaaaaggccgtgacttcccacagtctttctgaatttctggccttagcaaaaacctgaaaaccccacagacatttatttaaccattttcccatgcaaacaataagaagtgggggaggaggatagcagacatctggcttactcaagagatgatgtgttagtctggacttagaatattcccagagaatattcctataatctgtattagcttctcatttgtgaatattctaacctcacagactctgacgcattaggacaaagccctttgcaagaaactgacttaatggaaagctcttaatgcaagaaagtttaggctcagggaatggactttatacactgagagatgtcaggaacacagggaagcactgggcaccttacgaacaaagtagatcgcacaactccatgtgccttcattctcaggaatctgctactaatagccttgtaatcattactgattgagagatggcaacctcagggccaaatgaggctcctgcattcataaaattctcagcttcataactgctgttctacaattttgaattctactgttcattttaggattttcccgggaaagggtagtggctgggctaacgtgtattgcagtgggcagaaaaccagcaagtgtttctccaattatttgctttcatagcttttctggaatttggacccagtgctgtggcttgaaagggtgaaacacatgcatgtatgtggcttgaaagggtgaaacacatgcatgtatgtgcacatgtgcacatgtgtgcatgtgtgtatttgtgtgtgttggggataagggaacatgccccagttaacgaatggagcagtgggccagatccacatcctgtgtaactcccacaggctcctgctacgatgaaagttcccttcacagggttgaacacagtgattccccaagggatcctggctgaagtgggtggaagttcagcgtttcttgtcccactgaatttttgaacatgacaaccacgtcctgctcctgatactgtgtgctttccttgattgatcatgtcaagatagccctgctaacattgtgttccaagcctggctcgattcttcttgatataactccaggaaccaaatcagccaaaggccttctttctctaattctaattctaattcaagggatttcccccaacccaacctctgtctccatcttcttagtatcaagctctgcccaaagttgatcattcctgaagaacaaggcatgcatttatagcataacaatgatttcctttagggactttcagtaatgcaccattcatttgggacagtgatgtgacaattctcaggcaaatgtggaagtagatgtctatgtcatttgtgaatatgtagaaataaagagttcatttacatcaactgtcccacctctgtcccatacctctccttccccatgaagaaaagagaggcagaagtagaatttaagtagaatttaaaattaaaaataaaaagaagatattttaaagggttaaaatattaaaagaaaactcctttgaacctcaataaagaaatggctgttgaatctcagcctcttttgccccatcttcctaatggctgggcccatttctgttgccacacagcccacatatcctaagtagccccacatctctatttttgtcttattctccttttgggatcagacttttatttgcaatgtagggttgctgtatccatagcacatggttaactctaatatggatgcaattttcataagtatttatattttttaatgaaatacatacacacgaaaaaaagcacacatgcagataattcacaaacaatcaaatccttgggaaagtctctgccatctgttcaacaaggtcaagtgtcattaggagcacagaacagccaaatgtaaaatttcttttcaggagctttccaagtggttggaataaacacaagttagaccatgcaaaattcttaatgtatattggtctgggaaagtaaagatggaaacagagaatacctagggagctatgcaacacaccaagggccattatccacagtaacaataacagtgacaacagcaataataatgtacaatgctataagattattaaaatctattctataatgcacagagaagtacctgcttgaagccattaaatatatgacagggtctgtcttcagtgcgatatatcaaatttggcaattgaaaggtatataaaatatatattttttgctttcaaaatatggaacgaactaaaatacaaggcttttctgataaactataaaaatttaatcagcacttggatctaatgacgtatctttataatacttcctctgcagatacattcacttagttcaaaccttaacatacaaagttagcctcaggagaatcatgtttccttccattcatttcttataaatattattatccacttgaagtcgttctgatgaaggaatttcctccctattttttcagccttttttttctcctcttagctaagaagacatcaggaagacactgcccaaagtattcattccccatgacttactttcagtttccatttttgagccattaaaaaaaaattctcaatgttgcactatctgagtgattatattagatcattaacatggaaatcttaaaacgtggcccttaatgttgtttgtctatatttgttcctattttcatctttctctttttcttctttttccctttcttcctgtttccctcccttctttccttcctttcttccttccttccttcttagaattcactgaagtatttcctaggttgtcttttacttactactttaatcaaagcttatctttgtgcccaatttgtaggaagtgaaaatgtctctttgaaattctatattacatagacagagaagttgggccttcgagggcttgagtttcacttaaatactatacacatgtggtatcacacaagggggagggggagggaacaaacataaacataacaattattttcagtctgtctttacaaaagaaagcctcttctctatgaaagtctttttgacatctgctcctggaaacctgccccaagaacacattctccattgctttgcaaggatctctttttaaaagcacatccatccactgtccccaggaggtcacgtatgttggattatcctgttcttagttgagcaacgaataagcactggatgagttttccagggataagctggttgcttctggggtggaaacattatatgttcctgaaaaacagagcagcaactcagccttgaagacaagccatcatgaactttggggtgtgaacatctcctaagggacccaggggagcagtggtctaggcactaggtaaactcggccatgcctggaaaccaacccatacctgccctcttcccaagagctagaaatgccagagaactaacagagttgtcgttctcatgcatgtgtggcagccaacaagcagtcactacttcacatcataccagcagccaggtttctacaaaggacgggaagatgtcaaggtgggaagccctccatatgccatcacgtgcatggtctgggaacatctgcatgagggaatctccctggtcctcttgggttgtggtgacttacagaagctcttgggaggcacctggaggctctactgaaagtggaggtttgtaaagagagtaaagggaaagaaaagagaaaattatagggagagaaaaggcaggaccagaaaagaagcaggagtcaggaacgtcaacagaactgctgagaatcagtgcagcaaggaaggcagcctctgagcaactgcacaggcttgtgtctgcggggaggtggggactgtgcacagggagtgcgtggagagtgtgtgtcgggcaagaaaagggttgaagtgcccaccctaccatcaaattgctgaaccgccaccaccgctaacaaagtttccgtcatggcctggggggatcttaggggctgctgacaacataaaccaaagttacggtacttatggggcccccaaacatgcccaattgggactttcataatcagaagtgaaggtcccccagtttcatgggtaattcatcaaattgaagcagaaaagaacccaagtcctctggagttttaacagttataggcattcacaaaatttgcttgtatatgaaaagccttaatgtggaacattgatacatttctcaactctgcatttgtgagatctgttgagtttcaaaaagctagaagaaatcctggggcttattttcctgtgggggagggatggtggcatgggacaggggtttcaatttgctagaatagctgagatctgttgcccaaagttattaattccattcatttcaaatctccaaggtagaaatttaactgtgaatatttctaatagaatagctaactagggtgatcccttatgtaatgcatgcacacttctatgtgcttccatgtgtaacacaagcacactttataaaaagaacacaaaaggaaaacaaacctaaatagtgagatcctgtagtaagattttctaactgtattctttgctgccccgtaaccctgaaacatcacctatctactcttatttgacataatttgagaagaactctgtgtttgacaaggccagcaatttacagttctcattttgatggatgatagtttgacagacagctctccaaatcattgtctagattctccaaatcttattctttatgagttattataagttcccaacaaaggcagctgccctctgtacccactttttggtgatttgtgaaaatgtaagttcctctatttaacctctaccccaaaagaggacattttaggtaaatgccatgattggggtgaaagagtaggggtgttgaggctccccatttgaccaaatgtgttctgggcaagcagggagaacatagaggccactactcacctgttttaccaaacaaactgttaaatctccttgatattggagaactcatagaaaacacaggtgtggatgaacccagggatgttgactagaagagagaaaaaaagggaaaatcacaaagcaaatttgtgggaccaaagctgtttacatccctagaaggattgattttccaccctctagtggtcactgccggcatctctagtcccactcccagaggtcacattaaaatactggaatcttgtcatctgtattagaaaaataactgtcaaatacaagttttattgtttgttaggcttctagtattttctgacatgtgaaaggcagtcagatatatccaagggcaatagttatgttccacaatgaactatagaaaattttatccattattattcttcaacttgttttctctaatgccttgaatccccccagaagactgcttctcattgaacatttgatttcaaccttcagtttatatcatatattattttaaaccctatttaaatatgtggagtagcatctcaatgacagctctatggctctgtttaataggcagaatgacttgagaagcaaaaacaatggaatgatctatgccaaatatagctgttgagggagatgggtttgaggatgcaatatatttagcctaattaatcaaaatcctgaagaaaaaatttagtactctgtacttcagaatgctagtggaatacatgaggttataaaacgaaaagtatctgcagagaaaaggtttacctttgagtgtggtgaagaccatctcgacaatgaaaacttattcagcaaagcttcctgtacctgcattgttaaaaagaagctatcgtaacttcaacatgccagaagcacttcacgcttttctagaaacatgaaactgtcattgctcttaccttcagatcctagaggcatccaaagagtaaactgaataatccctgagaaaaaaagattaaaaagaagtgcattttaattatagtctattgtccagcaaaagagaaagtactattaacctggtgttaaatttgtactacttctttttctatctgagtttatggaatgagtccagtacatgatactgttcaatgagaggcagttggtccacaccaagggactctaaatgttatgatgttaggaggatattttctattttcccattttcctttggttgagaactggaggtcctgttggttatgctatttatacacctcttgtgtctacaatattcctcacatagttgtgatgagaatcttggctatggggtgggataactagttccttccaaatgaggcatatcatgaaggtcattacatatgaactttataacttggagacacaggcccagtaacagaaattaaggttcatatgttcttggcacaagcatcctgaaagcagtatctcaagtgcacctccagcctctgcctcttcacaagctcacagtggcctcaatccttgggcaggttttttcctgtattatcacctctccattgggtgaaacagaattaatcacttccttccttgtggtttaaaggcttgctatctatacctctgttatatttcttctaacaaactggtctgcattgtaattagttacgtgctgcaggagagcaaagaagatgttttttgcattgtagtacaatcaagcagattgtctggcattcacaggacattcgttctttgatttttgatgtttccagagaagctgctatgtggtacataggatttatttcattcaaatgattattgagaacctactctgtaccaaggtctctatcaggcatagaggtatagtgatgaacaagaaaagggcaatccctgtcctcacaaagacaggattttcatttaggagataatagactgcatcaagataatcttagacaaatggggattttccttttactggtgtaatcagggtatttagcagagactgggaaatgacactaaattataatgtaggtgataaaaagcatgaggttccataggatcagaagaatgtgttctttccatctcattgaattctcattattactgctctttagagctgaggcttcctctgggctgaaatccttccccattcctactcttgtttgtgtttctatcattaatttgtcctacaggaataaaatcttcctgaaagtcccgcactgcaaaactcacctggaagacattgaggatggcaaatacgatatggaacacaaggaacactactgtctgctgtcactggttaatcactagatgccaagagcttactgaacaaaagcttggcaatcagaataaatggggaaggaaggaccttatgaattgtctacttagcctaagaaacggcaggtttagttcttctcttccaaaagatacaggtatatcactggaattgtacttaaaatttatagatgactagcaaatatatactttatatgtacttaacatttagatcaatcttatttaatacttggaggttagaagaagcatctttaggggaactatataatattctgttagcattttctctgcattttaaaaaatcatttcatctcaaacacttatcagcgtcatgaaatcagtaatgactcttaaacaattcaacataaaggtttgaactctgcactagatgtctctttaattttttaatatttaaaatttagttcaggcttttctcaccaggtgcctttagtggtgactaagataactgacttctcaattgtttctctgaaaaaagtgttgctgtgggaataattttaatgttcaatgtgatatcatggtggagttttgtcttttaaaacattagaagcattttaaatactaagaatcaaatatttatagatcaaacacttgtgttttaagtattatacgggacctgtttacatatagtaaatgtgtatgtatacatgagttgttgctgaagccgacaagcatattacatacatgcattttccctgtgccatcatagttgcagttagagttctagtacctgtaggctcgcctgggaggcagattagacccaaaggtagacatttttccctttccctgaagcatgatggtggtagttgattctttgatttccttagtaccaaactttaaggcttttgtaaaaacaaaacgaaaaaactaggagcttggaacatttaaaaattaacgctgctaccatcaattcatcaaatatttacttagaaccttcatacattaagattctggtaaccaataaattagaatttatttcttctgcataaagtaaattttcatacactcgacctactgagacagcaaaggtgtcctaatttgaggcatttgtgtaatgcctacataactaaatggtaactaaaatgggacagcatggggcaagaccttgtagttcttcacagactatttgtcatcagtttctccaattaatttgctgcatgagccaaataaccataattcaccttttgtacccactggagccataattagagaatcagagggtgtagacagaggttaatgccaatgacaaacacagggcaggatttattattattataaagatcattacatacaaaagattttttttttaaattcctaattctaacaaaggggatcaaccagaaatgaaactaagctactttctgaagtgacactgtgtcagaataatccagatttgaatataacattttgccacccactgacatttagatgaaggactgcctctccggaagagttcagaacatattcaggggtgaacctaacaccagggaagaaagactactgatgaaaatatttttccactttgaacaaatctgtaaactacacctttctttatagaaaaatgcttggaatagtcactgtaatatttagctgtggataaaaatttgtgaaaataaatacttttgaattagaaaaagcaaggaagaagaatggggttgataggatgtatatttaaaatagattaaccaggaacaactgcactgtgttttatatatgtgtgataacatatgtataattatatatcactatatataataactatatctttatatctggtgcaggtgagtaaataacccatgcaaatatctggggaaggaatagtccaggcactacaggaatatcaaaaaggccaatatgacacaagcagagtaatgacagagtgatatggagtgaggagcagatgaaataataagaaaagtaggcaggtcgttttgaggggtatgtgtctcaaattctaatttgcatataaatcaccaaggtttcacattaaaataaagattctgattcaggtggtctggagagtttatatttcttacaagtttcaggggatgctggtgctactggtctgtgtatcacactttgaataccaaaggactggagatgcgtgcatggtaaggagctttgggatgtgagtaatgtgggttgaattgtgtcttccccaaaaagatgttcaaatcccaactctcagtacttgtaaatatgacattacttggaaataaaatcttgcctagtcaatcaagttaagtggattcagatgggcccttatcaaatgactagtgtgcttgtaagaacgtggatatttagaaaaacacacagtggataaagtatgggaagatgaaggaagagaatggagtcatgtaactacaagccagagaatgccaaggattgatggcaactgtgagaagctaggaaaagacaaggaaggatcctcccctggagccttcagagaccctgagactgatgacaccttactttcaactcctagcctccagaactgtgagagaataaatttctgtacttttaacctactcagttggtggtaatttgttgcagtagcctgaggaaactaataccttgagtgggatggagagtgaagtcattggagggttttaagagaagaatggctcggtctgacttattcttaaagaatcaccctaattgcagaaacaagaatagactgaaggcaaggggctacagggaagtaggaagaccagttaggcggctatagcagtaaacctaactggagagtggagagatggtggtttgaatcaggggggtagtgatggtggtgagacaggaacagaatctgaagatgttttgaattactattgataaaatttgttaacattgtatgagctataaaaaaatgagggtggctgggaatggtggcttactcctgtaatcacagcacttagggaggctgagatgggtggactacctgaggtcaggagtttgagaccagcctggccaacatggtgaaaccctgtctctactaaaaatacaaacattagccgggcatgttggcgggtgcctgtaatcccagctcctcaggaagctgaggcaagggaatcacttgaacccaggaggtggtggttgcagtgagccaagatcatgccattgcactccaacctggatgacaagagtgaaactccatgtcaaaaaaaaacgtagaatgatttataatactttgggtagaaacctagtaacgggattgctgggtcaaatggtgtttctggttctagaaccttgagaaatcaccacactgcctttcacaacagttgaactaacttacactcccatcaacagtgtaaaagcattcctatttctccatatcctctccagtgtctattgtttcctgactttttagtggtcgccattctaactggcttgggatggtatctcactgtggttttgatttgcatttctctaatgaccagtgatgtgggagatcggtcagggtggtgggagaagctataaggaaagacgcaagccttcttgaaaggttggaaggtcttgcaaaagcttcatgagagaataaaggtgaaggaagaaaattctctttctctgaggctaagggtgagaagtaggtgcaaggaaaagtgaagaagtttatctaaatatgcttgtttacttatgtcatcaggaaactgacttttgaacttctgagcatgagactgctccctgtaagagggagcaaaaatgttaattacccagcaattgtgttgactccaggccttggacgttatgccagtactgaataaatacaagcagctctggcttatcgagactgctaactctcctctgcccctagggctcgcagcctcctagcctgctcttaccctgtatatttgtgtctgagtactcctttcttctgttgctcagccagggtctgcgggatggacccggcacagtgatgatgagctttttttcatgtttgttggccgcataaatttcttcttttgagaagtgtctgttcacaccctttgcccactttttgatggggttggcacaagcacatgtatgtttactgcagcactattcacaatagcaaagacttggaaccaacccaaatgcccatcaatgatagcagcctggataaagaaaatgtggcacatatataccatggaatattatgcagccataaaaaagaatgtgttcatgtcctttgcagggacatagatgaagctggaaaccacagtctcagcaaactaacacaggaacagaaaaccaaacactgcatattctcactcataagtgggagttgaacaataagaacacatggatacagggaggggaatattacacacaagggcctgtcagggagtcgggggtaagggagggatagcattagcagaaatacctaatgtagatgacaggttgataggtgcagcaaaccaccatggcacatgtatacctatgtaacaaacctgcatgttctgcacctgtatcacaaaacttaaagtataattaaagaaaaaaatagggctgccaagggtataaacagggtgtttcgtggcttaataactgtataactataaggatggagtctattacctcctgatatgaggaacatgatgagagaaggtgagaatggggaagatgctgggtaagtggggagaatagtaggagattaagagctctttttgaggtatgttcgctttgagatgcctattttgcctgcaagtggagatagtaattaggctacttggcataagtctggagtccagagcataggtctccactggagatttatctgacatgagttattaaaagaaattatgatgtttggcaagcatgtccttaagttgtgagattaacatcaagaaggacaatcatgtacttctaaaacatggtgttcagtgtcacttatttgaaaacatactgggccattatttgacctgtgacagttctgacattcattctaagactaccagatatgaaagtcaggagactgattagtttcttttttggtgcttttctcactctaaacttcaactttccatatcattaaagccactaaggtaaacaattagcctaagaggtatattcattacttttttgctgcctttaaatttgatgcctcattgtaaaaaatatgacctcacttgtatttgtgtggatgatattttaaaagatcatactgggcagagaatatggacactttcattatttaatactttagactaatgccaatcattcaaacatgaattcttcattcatctgtcttgtcaaagaaacagagctcatattgcatatgtgaaatatcacctagtgtctatttcaatcgtatatattttctgtttgtatcttagaaaaattatttcacctcaacaagcatattgcttgttggaattatctggatatagtgataaaataattattttcatcaacatctgaagaaaatgcctatgtatctgttgggatgggaggtgggatggagaggtgtgcagttgtctagcaccacttgtggctgggaaggtatgtgtgtctacagtaacagaaaaatctattgtcaccacaaagattccccatagctcctttaaaaataaacctgccatcttgatctccatctgcctgaatctttggtatctctcccttagttcaaaattctgacagagaatagaagcatatttatcaatccttcaagccccagtagaaacatcagagggagaaaacttaacctattttgaaatggttgaccaattctcagtgacaaagctacagttacagtctgattttcttgtccattgccaagaaaaaatgattcagtctgactccaatttataagggcatgttgaaagcaagaatcctacttgtagagattcttcttctaggcatgaggaatggtttttccaggtaatggattcctaatttgcccttctgtggaactagatttgcatgacagatgacagaatatttgtcaccttaagattcttgaaaaattaatttaaagccatgctatttctaattgttttggcttatgctctgaagtttttttttgttttgttttttgttttttgtttttttgagacagagtctcgctctgtcgcccaggctggattgcagtggcgcaatctcggctcactgcaagctctgcctcccagattcacgccattctcctgcctcggcctcccgagtagctgggactacaggcgcccgccactacacctggctaattttctgtatttttagtagagagggggtttcaccgtgtttgccaggatggtctcgatctcctgacctcgtgacccgctcgcctcggcctcccaaagtactgggattacaggtgtgagccaccgtgcccggccctgaagtttttctaaggctgccaaaattgtggtcaccaacataataggtaccatttttccattatctagtgtaaaatatatataatatgttatataatataaaacttaatatatctgctggtgcatatagctttattatcatataagctatatgaaagcagaaatatgcatttaaattcaacatttgcaaaatgtttccttttttttttttttttttttttcttgagacagagtctcgttctgtcgcccaggctggagtacagtggtgtgatctcggctcactgcaacctctgcctcccgggttcacgccactctcctgcctcagcctcctgagtagctgggactacaggcgcccgccgccacacccaactaatttttttgtatttttaatagagacggggttcaccatgttagccaggatggtcttgatctcctgacctcgtgatccgcccacctcagcctcccaaagtgctgggattataggcatgagccaccgtgcccggcctgcttttagctcttacaatcgagggtaaataagggtggattgcaatatgcatatatttgaagaaacctgatacacattgcttcattttttcatacagccttaagcagattattaaatttacctttttatttgagtactaacacttttcctacatagttagagagagctgtttgctcagttaatgcagcaaagggatgagggtaagaatgtgtgacagttagctcattctaatttgcttattgattgttggacatattccctcaattagttgacctcagctcctatattggggcttacattaggtgaacacccagggtctcagggctccacgtgggtgtttgaaatcacttgtctagatatataaaagagaacaggatatactcaccacttgcttggacacattttactgcctaaacggttcatttacactggccagtgatgcattacttcttgcccctaagtgtttctcaatctgtgttttgtatctaaaatacgcctttttctccataatcttttaagttgtctttttttgctagcattgcttataaaatctcattttctccaagaaatctctcttgaagcttagaaaaacaaaattggggtaatattttctaggtaagtaggcacaattctataattctatattccatgatttgtattaaatataatataaatattgatacatattctttgtctttcagaataggtatgttatgttcatatgtgtcaggttggatcagtatttaaattttactactgagataaacaaagagttattagcaatttttaaaagttgctgtacaatttgtcatatttcattgtgcttcttaatgacaaatatgtccaagattatattgggagctgccattttctgtactttatccccagatttgggagtgatacttattacagctttcagaatttcaagaaatagtagcactacttttaactagactaaagtcttttgtttttcttttgtataactttctggacatttgtaaattcataggatgtcttcctcaaatcacaaaatgcctatcgtctaattcaattgggaggtcagataccggtttaattctggagccatatgaatattgcctgagttaatgttatagctgaatatcatgcaaatgtggaaaaagtctattgaatcaatgtcattttatacatggaaataagcaaacagttgtaaataatatggaatattaaaaatctttctagtaaaccattgtttatgcttttcaattgtcttgctaaagaaacatagcttcttttaccatgatggaaaatattgtgctggaaataaagaaaataacaaattttgggtctcagcttaggttatcagttacctagtcttaaacaaatgatatatcaccagtgaaatttagcttttagacatcagtaaagtaagaaaataagccttgtttaccatgaaattttatgcaaaaattaggtaatatttaactggacttataaaggacttcttttttcaagaaacaataagaaaatgacctgaaatagtataagtttttattcataagtaaaattattgctaattcactttacaatagtctacttttattaatggtgatccttgcatattaagacttacaatcctattaataattgctcacctacaaaggacatttgtcaagggatcaaagtcttcatgtaccacataaaatattattataacaaagtaaaccagctgtatgcctttgatcactacatcaatatctagatcttttagcttctatttctgttccattctgctagccaagggtctttataaaaatacaaaggaaaatgaacagctagtaacacatttgatgtgccactctgatggacttcagaatgcttaatatcatcttgtttaatttcatgtttcaaaaagcttctcaatggcaggatcaattactttcaatctccacatcaatcagtccagatggttctcatgatttgctaaggatagctgcaaactgaactttgtgaacccacgatgcatattgtgttaatccttgatatggaaggatccttctgcagaataagcggagctgaaaaaggtgtgcttactttcacaaactgaatgttatttaaggaataaaaggtattctttaaagtgttaaatccagatgaacactgaaaaatacagtcttcagaaaaatcaagtgatttcacttctgtattcattgctgaaatgagaacatcatttcatttctaattctaatttgaattttgatttaaggttaaaaacactttaggattgtttcttattgcagaataatctgtaacttgttctgtaaacactagttgctaggctaaaacagtgagttatatttctttgtgtatgatactatttgtttattgtcaatttttcctgaactcaccagtagaatatattttaatttgaataatttaagaagcaatgtcaccaatatggatagaacaataatttcacttttgttactaatttaattaagaaggtgatttttagcaatatccatttctatttggttgtgtttttatctatttcaattattttctatattggaagtaattatgaattttaattttcatacagccctcttatcttttacttaaaaaatttaatgtttaatgaatttggagggagggccaaccttcattcttacatttatttatacattcaatgggaaagcagtactattctcctgaatgttcaaacaagcaatggaaatttgcaagagagaaataatttaaaattttcatcacattgtattgaaatttcatctttgtttccattttttcaccagatcttgagctcttgaagatgcattgcccatagatggtctcattaatttaagcaatgttttcagggcagttattctgtgaatatgcctgtaggatttaactggtctttgaattatggatattatttggaaagctggagaggagagtgaaggacactatataggtaggcaaacatcttgaaattttgaaacattgtgtaattattttacacataactgcctggacatgaccaacaggtataagaatagaatctgttggttgctaaaactatacatttttagttaatgtccaacatgtaccaatagatgccactgaagatcttctatgaagttcctcctaagagtcataactggtgaacacagttcatccatggggaatacagactataacttactaatggatttaggaaggaatctacctagcatttttgggaaaatgtgaataaatcaacctgatcaatgtggtgggctcctctagaaaatagaaaaatagggttaggctaagtaatgtggagatttgagaagatagatctggggtgatagaatattagatataacaaaggcagtctcttcaactttaccaagtttttattgtcatttgtgctggtgtctatcaaattgtatgtgactgcttgctttcaatatggcaaatgcatcttcagaaacattataactaagataacttttccaatagagtgcaaaatgtgcatctctagaaaggtttactcagagaactctggcaatacaatgccacatacatgcagcgttatgatctttagtttgatttctccttcccttgaccctgaataggactctacagtcaaggaagttgaatggagaaggaatttgagacgtcaggctgtgtttgttaaaagggttttatgatgtcttctctttgagtaaatatactggctattgtatctttcttccttccttccttccttcctttattgtatcttccttccttccctccttctttccctgtttcctccctccctccctcccttccagccttccttctttccttctttctttccttcctccctccctccctccctcccttccttccttccttccttccttctctctctccttccttaactcccttctttccttccatccagaattatttttgagaaacgctgtgatgtgtcagttggtagcacattctctggagctggttgcttggattaaaatcataacccttcctcctattagctatgtgaccttgaacaagctactaggccataaattaggactaataatggcatcaatatgatcttgctatagactgaattgtatgagttaatgtatgtgaagcatttttatatggtaagaattggataaaatacagttactattttatttattgaacacttagcattttttagctttttattttgaaaagatcttagatccatagggagtttcaaatacagagaggtctcgtgtactattctacacagtttatttcaagagttacatcttgtataatttagtacaatatcaggaccaggcattgacatttatacaatgtgaattcataggtctatgccaattttatcacgtattgattaatgtgaccattattacaattaagttacagaactcttccatcactaaaagtgtcttcctcacattttatagccatattcatctcacattcccataccatcactaacctctggaaatcactaatctgttttctatatgtatgttattttattaaagttatatacatgaaataatatgccatgtgtccttttgatatttgctttttttcactaagcataatgcccttcagatctatgcaagttattgcatgtgtcaaaagtatattcttttttatttctgggtagtatttaatcatatggatataccacagtttattcaaccattcacctgtccaacatcttggatgtttccagtttttctctgttagaattaaaggtgctatgaaagatattaaagatcgcatataggtttacatttctcttagataaatttccaggggtgcaattgctggatcttattataaatatatgtttagtttttaaagaaactgataaattatttccagagtattataacattttacaattcaaataatgtatgaatgatacagtttcttcatcattgccagcttttgttgtcactatttttatgtttagttgttttaataagtgtgtagttacctagtattttgataagagctgaggatacaaatttgagttgatcaagaagtcaaacaaatagaaagcaatcattaaagattacaataaaaataaacgaagtgaggagactgctagtaaccagggaaggaactttaattaaggtatttcagaaaacttcttagccgagatttcaaagaacaatgatctaattttacaaaaagccacagaaagcttattttagaaagaaagagaaacaagcacaaaattctagaggcagaaaaagggttggcatatacaaagactgtggaaataattaagaatgttttgggtgtgataagaaaagaagggaagtgtatgacgtggttggagaggtaggtagaaaacatcaagccaggatctatggtcattaaaaagaagttggaaatttttctttatattagcagaggaaagccaaacaaggagttaaagcagaaagtagggaatgaagagtcaagatcttgtgtgctttaaaaaaaaaagccactctgactactgtgaaaatagagcatttagggaggagatgacaagtggggaggcagatttgcaatgcattgtggtattctgacagagagatgggtgtggctttgagaagtgttcacggaagaaacggaaatcttggaaatggagagtcatggggaaaaaaagaacctaggtcgacctctaggttttgggcatgagtcatacaggcacagtgtagtaccatttattgagatgagaaaagctgttgaaggaattttgttttgctttgtttcagtgtgaacacgtgcagcagtcagcttgatttcagacatactaaatttgagttttctgttagatacgcaggagatttcaaataggagattggatatattagctaaaatattgcatctgcaagtctcttttttcaactgatcttagatggatggataaataagataaaccagttgaagtccagtggaaaaatattccattaaaataagacctatttgggcttctattatgatattttgccctttcttatctctgtgactagagtgaataataataatcagagatgcagttttctcacctgtgcaatagtaatttctattagatatgcatagtgtggaaaattagctaaactcattcatacaaagtaactctgacattgaaggttctaaaattaacaacatttagaattttaatcttccatctagttttaccatttggagtatataaggaaacctagaaagaaaccttatatccacttgtctatcctataatatttgcacattatagggtataatctcagggcataaatacaactttttataattcctatagagtgatactcttaggccaatattactgatcttgaaaagtggggtattgaggtattttacttggttgtaagccatcaacgtgttttacaaatgtgatattatgttttgatattagtaaaaaaaagaagcttcaaaatgtcctctctttctttgaatgcaatcacaatcatttcctttttgaattttaaatataagtaacctaaaacttaataacttgctcacaagtctagaagcagacaaaatatcacccacaaacctgatttataatactacgttaaactgacttaaggttttagacattcataaacatcttttaatctattccccttttgcatggatatgtaaatatatactccaggaggtataatttttgtagttattgtagtgcttttgtaatgaagaactaagtctattttcacagtgatagagaattgagttgagttcttttgaccctggatggatttgtctattttttaaggtgctacttaaaaatgtataggagaaaataaaaataaattatctctttcataagttaaaaatattttacatttcagcattctgaaagcacagaggtttcaacaaaaatgatggtttagaatcaaattcaataaagaaacatcagcttgagatcagactctctgaggaatgtttttttttcctgatgaatctcagccattcaaggtccttataaataagtgagagcacctttgatttttgactttttatagttaacaatttcagtttgctaatacaaaagacctcatgccttttcatccagaaaacagagaacactttctattatgtaagagtattatgtttgaaggagtatgtttgcttcaactatgcgtgctatggtacagaaagaaaaaccacctccctgtaggtctaaatccaaggggttttcaatgtatttgggttaagttatgttgtaaggttatagctctctaagatttttacaagatgcattattaaacatgaatcttctgtaacgtgtacagcatatcttgtataaaacaatgcaatattttcttctaagtatgggatggctttggtcacccatgcttaaaaaaactttgaagagacaattcatctttttcctatgaagcaatttttattaattgacataattcttcagcagtcaagctattacagtcattaggtagtcctttcctttattcagaagcccaagaagttagtagaggtttgtatactacgcacctttcaccagaaaataaaaagggagaactttaagtatttgacatcatcaaaaattaggtgttatggtgctatgcttaagttttgatattatatattaattacatttcccttagtactacctcctctgaattcttgagcttgtcagtagttgaaaacatttgaacctaaaccatttttgcacattcagaactaaatgtctgggtaacttgggaattaatactctacaacctgtgatggagcagggagcagggtcagctgtccattagcatctcttgtgaggtctctccattttcataaagaggcttgagaaaatctccagatttgcctgagggtagacacaaagcaatactcagttatactcaatgttatcaacctactggacttggtataaaagactttttgagcactgtattgcctattaaaaaacagtaaagtgtaaaagatagttctttagacaaattgggccacggaaatgccaaatcattagttttggtgtctgtaatgcctcacaaagttataaacttttatgaataatttgctaagaaattagctctaatgacaggtagtttatgtatataccttgataacatctacaggtatcttatgcacatgacattatagaaatatttgtttgggtttttctcaaccagtcattttctacaccataattccagctcagcccactccacttgcaattgcttgctctcatcttctaactcctgtttattcttctcaatttctgctgtaatggcttcatttaacctgctcctctgtatcttgtatgctttttagttcactgcttatttccttcttcctgctggaaaacttggctaaataactcgtattaatattttagcctcatttggctttaagattatctcataaggatatcctatataaatggtagttaatatttctgagcaccaacttcccttactccagctctcagacttcttcccattgttatgacaattgaaggctttttaaattcctgtcttaggaaaagtggcccaaaatttgccatagatctatgatgttttaattaatactgacctctgaatgatctagaaaataatggtaaaccatgtatacatatttgtgtgtgcacatgtgtgcatgtatccatagcatctgtgtgtgtgtacattttatagattttgtctttgtatgaagaaatatattgaatatccaaataagcataatttctctacaagtgaggtatgtgggttaaaatctagtgaacaaaatataactatacattcatgatttggaaaccttttaacatgattcctgaggaattactcaattgttaattgtttctgccttctctaccaaaatgactaatatttggactgagaagaaaaaaagagaacctcggtaaggaaaagtggaatttctgtaggtggtaactctggaatatcccaccaagagaatgaatcagattaaaataatgactgtagaaatttccttgttagtgaatattcagcctggccttaaggaaaatgtagctctctcttactgctttgtatcttatttcttttactatgtcaattctcaccttagtagaactactactagttctagtaccatggctatcatagatgcaaccattatattccatttagtttcttcctcaggttccctaacaattgtttgaaactgaatatatatgtttatgtatgtgtgtgtgttcactttcatgtatatggtgtatatgggatgtgtgcagttttcagttttatatatattcatatatatacatgcatatatgtgtataatatacatatatacatgcatacacatgtataatatacatatatacatgcatacacatgtataatatacatatatatacacatatatgcacacatataatcactgagttccaaagtgagtctttatttggtgcaattgtattctctcccctctgtctgctcactggcctttgcaagacatagcagttgcttgattttcctttggataagagtcttatcttcggcactcttgactctagccttaaatttagatttctattccagaatacctctcatatcaatcttaaaacctaagatgggtaaagaggtcataagatttttagtatgaaagagtttgcttagttaaattatatctcaggaaactcattcatctaccagttaaattgtaaaatattgtttgttgtatctgaaaaaatctttagaacaagaaatgtaactgggtagcctgttatatcaaagaaccctcgatttattaagtctcctcatagccatatccttatatagccctctctgacactgacttaatagacacttgacaaattatagtaaatttaggcttgccaaattaaaatggcagcaatgccaaatgagaacctgatctactctaccagagagactaagtggaggagaacccagctgatagcaccagtgaagtgccagatatttgagtgatgtcactttggactatgtaggccttgtcagtcatataaggaaacctaggcaagactccgactattatcctcctgagcccaaccaaagttaacaaattgtgagtttgtgttttaagcaactaagtttgatgactgctaattacacagcaatggataattgaaataacagctaaagcttaaagatgagataatgtgttgtgtttaaaaatttagcaagtgagtacttcatgaatatatttaccttgatggcattacaagctaaattttactgggctttattagaacaaattatttgagcattgatgagaaagtgaactttcaaactatcttatttacgtttatgtttcagttatcccacaaaagcaggaaattactttcaacaatgcacctgaggtattttatagtaactctctggttatttccatgtgtcaggtggagaaatatggatcagacacaaagacaataagattcattgctctctagcggaatactttttcttaaatgggtttattagtgaattgagaacttgatttgatgtttactctgacgtgtgatgtaaagttcttcctaaagccccctttcttttcctttttaaaattattaacatagatgaatacagagaatgtgaacatattagctatacagatatcacaacaggagaacagtaaatgttatgttttagactatttcaaccctaaaatatggacacaggttggaatgaggatccaattcagcataatagcctctaatggaatgggaaacatataaaatcctgtgttgctttatgaaatgttgcttatttgctgcatggttttaaaaagtatcagttttatttaatagtgggatctttatgtcagtgattactgatgtttccagcaagctaattcataccagggagacaatgtaaacatttagaaaggggattatatttctgtactatctgcatatgtcagatgacaacgagagtttcaaagtacaatcttatgaagggttgtattgcagatttggcctagaagcccaaaaccattaaatttttatcaaaattatacctgaaaattcttcatgttgtttattagcagtcattatctttacaaagatataggaaataaagtgatttccatctgttgcaatcacttgccttttacaatagacaaaattgttattttcattagattttacaaaaggaatgatatataaatttttaaaaggcatgtttaggttctttcaccagagaaatttagattattcttgcataaaatcaataaacataatccagcacataaacagatccaaagacaaaaaccacatgattatctcaatagatgcagaaaaggcctttgacaaaattcaacaacacttcatgctaaaaactctcaataaattaggtattgatgggacatatctcataataataagaggtatctatgacaaacccacagcaaatatcatactgaatggacaaaaactggaagcattccctgtgaaaactggcacaagactgggatgccctctctcaccactcatattcaacatagtgttggaagttctggccagggcaatcaggcaggagaagggaataaagggtattcaatcaggaaaagaggaagtcaaattgtccctgtttgcaggtgacataattgtacatctagaaaaccccattgtctcagcccaaaatctccttaagctgataagcaacttcagcaaagtctcaggatacaaaatcaacgtacaaaaatcacaagcattcttatacaccaataacagacaaacagagagccaaatcatgagggaactcccattcaaaattgcttcaaagagaataaaatacataggaatccaacatacaagggaggtgaaggacctcttcaaggagaactacaaaccattgctcaatgaaataaaagagtatacaaacaaatggaagaacattccatgctcatgggtaggaagaatcaatatcgtgaaaatggccatactgcccaaggtaatttatagattcaatgccatccccatcaagataccaatgactttcctcacagaaatggaaaaaaccactttaaagttcatatggaaccaaaaaagagcccgcatcaccaagtcgatcctaagccaaaagaacaaagccggaggcatcacgctacctgacttcaaactatactacaaggctacagtaaccaaaacagcatggtactggtaccaaaacagacatatagatcaatggaacagaagagagccctcagaaaaaatgccacatatctacaaccatctgatctttgacaaagctgacaaaaacaagcaatggggaaaggattccctatttaataaatggtgctgggaaaactggctagccatatgtagaaagctgaaactggatcccttccttacaccttatacaaaaattaattcaagatggattaaagacttacatgttagacctaaaaccataaaaaccctagaagaaaacctaggcaataccattcaggacataggcatgggcaaggacttcatgtctaaaacaccaaaagcaatggcaacaaaagacaaaattgagaaatgggatctaattaaactaaagagcttctgaacagcaaaagaaactaccatcagaatgaacaggcaacctatagaatgggagaaaattttcacaacctactcatctgacaaagggctaatatccagaatctacaaagaactcaaacaaagtgacaagaaaaaaacaaacaaccccatcaaaaagtgggtgaaggatatgaacagacacttctcaaaagaagacatttatgcagccaaaaaacccatgaaaaaatgctcatcaccactggccatcagagaaatgcaaatcaaaaccacaatgagataccatctcacaccagttagaatgatgatcgttaaaaagtcaggaaacaacaggtgctggagaggatgtggagaaataggaacacttttacactgttggtgggactgtaaactagctcaaccattgtggaagtcagtgtggcaattcctcagggatctagaactagaaataccatttgacccagccatcccattactgggtatatacccaaaggattataaatcatgctgctataaagacacatacacacgtatgtttattgtggcactattcacaatagcaaagacttggaaccaacccaaatgtccaacaatgatagagtggattaagaaaatgtggcacatatacaccatggaatactatgcagccataaaaaatgatgagttcatgtcctttgtagggacatggatgaagctggaaaccatcattcttagcaaactatcacaaggacaaaaaaccaaacactgcatgttctcacttataggtgggaattgaacaataacacatggacacaggaaggggaacatcacacaccagggacggttgtggggtggggggagtggggagggataacattaggagatatacctaatggtaaatgacgagttaatgggtgcagcacaccaacatggcacatgtatacatatgtaacaaacctgcacgttgtgcacatgtaccctaaaacttaaagtataatagtaataaataaaataaaacaaaagaactagtttgttgagttcatttaggaactaagttgtaagaaatattgcaccagacaatttgttttctgagatgaagctcaagtaactatgagcacagtatcaggaatgacattcatttgttcccagctgtctctaggcattttgcactcttgaaaaatactaagttccctggacctgaagagattcatgaatcagtaagaatgtgagccccttgagtgttcaatatcccttcaaaccttagaaactgtaagtcaatgacggtgcttatcatatcacaagagtatagttagcttcttttaaaagacataaaagacccctctgagttagccctagacacatattactccaactgcctgaagaaaggtttagcgatccatacagaattactctcaattagatttagagaaaacattctctctttgaagaacactagaattgaggaaaatatggtagagcatataggttattttgcctttgttactttgtagaccttaaatcatggagtgagttagaacacagtatatttgtgacaaccatgacagttcagagaaatgcagtgaggtcatttactctgaaactgaaagacactaatctctgctctgagacccacaaagtcagattatctgttttacctgtgtgatttctattcctctcattttgttgttctttttataaaacatctttgctaaataataaagttattactctaaggtagtgtccaggtctctttgataataatgaaatgtccatggccaaatcccattgctttgttttgacagtgtgctccaagaaaattactttgatatgccctctcatattagaataaacacattctacatacctattgcctacatcaagttttgaattataccattttcaggtttaacctggtcatacagcagattttcttaatggttggtgaacacggaataatagtttaatcattcagataaactattttgcagaaacatttaaaatcagaaattgcagaactactatctgaactttaaagggacactcttaaccatattttgttttatttagtactcacgctgacaagttgatttaccacctcattttcccaacaagtgtcaagatttcaatatgcagttaatggtttctaaaaacagtgactatttaattacatccttatagtttccccaaattgcttatagtttgcccgcatttagttaggtctataatatttctcaattagtgtaaaaatttctactcctttttaatcattgatgcatataatgatgtataaaaattattatgtagatagcccctccatgaaaacttaaagtcaaaagcttttagcatcaaagtatcagaatacaaactaaagaaaacacaccaattcagaaagattttctttaaatatattaaagtgaataaaatgttcacagagaatcactcacatctaaggatatagactttttcctaaagtgaaactatttttggctcactcagactctgagtagtgtttcactgattttgaatttcactggtcagaaccagtgttggtagtaagaattattttcccagaagagaatggaaatgcttgccaactctactttcaacccttgctggaatccctatattgtgggtagagatatgactaaattaagcagttttaagtctaagccagaaagatttaattattgatttattggttttacaattgttaaatattgcctttaaccgagtatatgttttatcatgtaataatcactttggcagcctcaaatgtcatgggttcacagggtaaatgttaaggtaatagctaaacaattgagcgtataggagatctatagtaagtgaaaaaaattcaagatgtaatacagagtccagtatgacagacttgagaaactttcaaaaactaggaaaagaaaaccaaaagtcattcttgcagtgtctctgattgcactgacttgatgcagaattggtgcattaacatatgtatacattacatatgtatacatgtgccatgctggtgtgctgcacccattaactcgacatttagccttaggctaaatgctatccctccccgctctccccaccccacaacagcccccagagtgtgatgttccccttcctgtgttcatgtgttctcattgttcaattcccacctataagtgagaacatgcggtgtttggttttttgtccttgtgatagtttgctaagaatgatggtttccagcgatagttgactgagaatgatgaattaaaataaaaatgcatgcactttcaaatgtacttagtgcaacatattgaacttacattccagttttcctggaattacttgtgtcttgagctaaaggctgtatttggtataacagggaaggaaagaaattatttttcctataaaattagtttaaaaacacatataattaaacaaaataaaaatattatcccaccttttaaagaacatttactaagtcacagatattacctgaagtttagaaaatcacctaagaacaattgtttaaaaattatttagggaaaatgaagcaaaattgtttttacaatctgagattttaacagccagtgcactcctgttcttcagctgaatgtccccttcattctgaatgtctgcagtagaattgaattggggagcagttaggttccaggaacatattcactcctgttttgttctctccccaatctctgcctttcggtgactgtttgggcaaagcctcccttgtggtagaagatgcctcacttctggggagaggagactcctcatcttgcagacaagaagcagcacccactggttcctgctccaaaagccattaacattataaactggccaggtgcggtggctcaaacctgtaatcccagcaccacttgggaggttgaggcagaaggattgcttgagcccaggagtttgagaacagccttggcaacaaagtgagacccaatctctacaaaaactagagaaaaaatagctgggtgtggtggcactcacctatactaaggaggctgggctgggaggatctcttgagcccaggtggttgaggcttcagtgagccaagatcatgcctctgcacttgagcttgggtgacagagtaagatcctatctcaaaaaataaattataaactgattcacaataactttggttttgtcactaatatgctgaatattttcgttacaactaatatacaaaatgcaaactggctatcactaccattctgataatggaattagctgtcctacatacctgatgacctaatgcttaacctaatcttcctctttcccactttgatttggaaacttgttacaatagagttctttacctcaaagtcttaaggaattcaagacaagactagagtatgttaagataccacaaaaaaaaaaaatatatatatatatatagcaagagctttcttgagtaagcaaattttatacatataaaaataatttacatgcaaatgaccaagaggaaaggttaagtgactctggtgtaaataattagtttactgattctgccagagcatattaagaaaaattcactttggaaaaataatatggatttaaagaagtaacaagtgggtttctctaaagcacagtttggctttttactagaatatcaagtcacctttttgggtgaggagagtacaatgggagtgggcagctggtgcaaataaacatttacaattacttaaaacttcaacaaatgggatctgtatttaaatctgttttggtctgtcttccctttgttttttctaatccattccaacaatgcaaacctcagccactgtcaagggcaatctcagactggaggttgctgcctagggtgaggttctagcaagactgacaagcagagctcagggaatagtctgcatgggaaaacagagccagacttagaaggcattgctgatgaattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattcacagtctgagatggctacattcattatggacaaacagtcaaacttgtgtgctcagttactggcatggcactcccaagattgataattaggaaagttgataagcagaccacattattggatgcagatgatcctgtgtcacaactccataaatgtgcatttgaccttgaggatacagaaagaaagtacttatgcctttctcaagaaagaataattcaatttcaggccactccatgcccaacagaaccaaataaagagatgataaatgatggtgcttcctgggcaatcattagcacacataaggcgaagtatacattttatgagagaatgggccctgtccttgccctggtcatgcctatgcctgtcgtagagagccttaagttgaatggcggtggggacgaagcaatgcttgaacttacaggacagaatttcactccaaatttacaagtgtggtttggggatgtagaagctgaagctatgtacaggtgtggagagagtatgctccgtgttgtcccagacgtttctgcattctgagaaggttggagatagttccagcaaccagtccaggtttcagtaactttggtccgaaatgatggaatcatatattccaccagccttacctttacctacacaccagaagcagggccgcggccacattgcagtgtagcaggcgcaatccttcaagccagttcaagccacgtgccccctaatgaattaaacacaaacagcgatggaagttacacaaatgccagcacaaattcaaccagtgtcacatcatctacaccaacagtggtatcctaactaccatctttttgctaagacttaaacggacttgagtgcagcaaaaagttgacaaaaaaggaaaaaaaaatgaacagtcttttgtggtttattgggaaaacttttcataccaggtgatactattctaaaaccccactatctatctgcaagtgccgatttgaaatgcagaagccacagtaaaacaaaaaaaaacatcaaaatgtacaaactactggaaattaattttttcagctgttttgttggttggttggttggtttttgtttggttttgtttaagtgggcaagaagtaaataatgtggctggaatacaagttgaacaaactagaagacataaatctaacatagtttttatggaccacgtaacttgtatattgtataagctttagtaaaaggtacattttcacatattcaccatatccttttttatatcatggtattatagtacatcttgtcaccaaagaggttgttctcttccccactcacctttgagcttttgctttaaaatacattcaggttccaagcctggccatgcttgtttaatttaattatcatgttcttcccagtttttttttggtctgaggctagagctttttttttttccagctgaagtcttatgacttttcgtgagtcaaaattgtttggatttcagcaagtcaaatcttgtgatggcctacatttttttttaagattatgtgaagtctgtgcaaaagctttaaaaagctgcctctgccttgcctgcaacacatgcaatgtatgttaacttagtctctcttctcagacactgttggtagttatttctgcattttccttttttttaaaaaaagtatttatagtggttatccaagaggttctaacattcacatgcaatttggtgtggccattttgccataaatgagttaatagtgcagaacatgttgatatttgaagtgttctctctccttttcccatagcgtaaatacattatgtgtgttccaggatttgttcaggtttttccccgctcctgatcttgtacataacttgtattacgtataagttaaacatttaattttgaacttggaatgttcccagtgatttcatccagcagagtattttctgccttgttggcaagtgacaaaaatatcatgagaagcaactgctgccagttgggagatggtgcccttatggtagaatgaggacgatctcagcaaaagcatgttttattaactttactttttgggggtgttggagggggtagcctaggccagaacatcattgtaatcttaaaacataagatgcttttattagatgatcaactaaaatagctggaagacagtactttagaaacagatagttgtaagattatgaaatgcaaatgtaacttgtgtttttatttttcttttccctgccttttttgttttctcttctccagtactgagcatctccacaaatgtctcctaactcagaaaatgtttcttttcctttcacctgagatttggttgcattcagggttgtacgttggccttgcatgcgaaacttggcagttgtaccttgctttcattcctgaacttcggttatgcttttgttcggattcttcgaaattgcagcagactctttgggctacatttagtacaagaaccacgtgcataatattatacggcacagtctagtaatacaatcatccttcttagagtaaaaactacctctagattgtggtaagcttttactgtctcataaaacaggagccacggtactttatgaatgcaaaactgtaacttcctacagtgtttccatacagaacattgtctttctggtttcctgggctattttggaaaagttttcattaatagacttttcagaaattattattagtaacatttttttccagctttgctgttttcatcactcattctttgctcagactccagcattcagtaccgtgttggtccagatgtaggtttatatgctcatttttagcttatttcttgtaccttgcagcacactctacgcactcagcccttaaggggtttactttacaaactgtgtgcctgtaagatgtattagcaataagatagaaaattgagcaagtttataccataattttgtagaaaaaaagaatctgctcaattccatatttcatccatgaaaaacttgcaatacgagcagtttcaaggaataagaagaaaaaaaaaaagagtttataggtcggccaggtctgatggctcacgctcgtaatcccagcactttgggaggccgaggccagcggatcacttgaggtcagttcaagaccagcctggctgacatggtggaacccctgtctctactaaaaacaaaaacaaaaacagaaacaaaaattagccaggtgtggtggtgtgtgcctgtagtcctagctactcgagagcctgaggcatgagaattgcttgaacctgggaggtggaggttgcagtaagccgaacttgtgccactgtactccagcctgggtgacagagtgacactcggtctcaaaaaaaaaaaaaaaattttatgggtcatttgtggtttatttatttctgcaaaatgtccattcccatctttagcccacttttaattgggtgattttttttagtaagaaaaactttatatattaaacattgatttttaaattatttactatatccaatcaacagctttctttaagaactctctaatgcaaaatagaagagtggtagaagctgagtacaaaaaggaaaaaattctaattaattaaatgtatctttgattaacagaaaactaatataagctacaataatattgttatttcagaattccccagttacaaagtaacagtaagaagatggtgatctacaaaactttacttgtgacataattctagtgtagtttatttaagaaatataaaagaaaatgattggattacaaaaaagattaatataatgatacatcagtattatgagtatctttcttaaataaataatattttctgaagacatggataataaaaaaggtagcacaataaaattatacagggacaacttattaaaataaataaacatgctcagttcattgtaatgaaataaaatttgttttctgaaaacaaatggaaagaaaataataaccatgttagcccagagaaaggaatacacttgaattatagatgaacaagggcatatactgtgtatgactatcatgtaaccatgaagaataggtcaagataagggaaaagcagcagaaacatcagttctcaggcagtggtgcctgagattattacagtgtgcccaattagtttatgtcacttttaaaaagtcatttaaataaatgtatttgtggaagaaaaaatatctgaacatcaggtatggtctgatccacaatgatccaacgatctgtcataactcattctaggagtattcttatacagtttgcaagagaaattacatgtggagctacagaggaacatttatcaaaattcataaagctatttaacctgaatgttacatagtacatagtgaccatcatacaatagtaaaaatacaatatctgatactatttttacaagctatgacgtaaacaatttaggctctttttaaaaaaataaaagaaatttgattacaactttatttcaagcattttcagttagacataggtttatatattttcactcaaaatggcaaaggaccttctgtaggtaaaatatattctgtgtttaaatgcttgcattctgaagtatgatttgccatgtacaagttcaggtaggacaatgaagctgctgtagcaaaatcctggctgatgatgaagactcggacacttttcatctttcatgcagccattcaatattttgtgtatttacatgaaggagaaaagaggggaggatacaaagagagccagtattctttttggatgaagcagcctaattccagagaatgagctttccattttgaactcaaagactgtggtccccaaattgaattcttaccagtccaaggagctgcctttggcctgtgaggcaacacttgatgatgaagtgagctaggaaagtgttaactgaactacagagatggctgcgtgcaaaacaagtttccaaacatgctcaggcccacgcagaggtgaggtgcagccagaactattagttaaaaataaatgccctcacggatgcagacatagagcttgtaggaagagtcaccgttctgggggcctgattgtagtttccaatacctgccttcaccactctctgactcttctatttttctgctttgtttaatttgagtccaaggatttcattagcaactttctgaaaatacaggaagacagtctcctgttttggctgagataaagtggctactaaaaccattttcctggcaaaaccataagtgtttttcaggttttactgtttccatgtgctccaaataaattttattgctcaccaaggcaaccagtagcaaagcttctgactcttcgctccctttcttcggtacaatgtacacatctttttttttttttttttttgagatggagtctcgctgtcgcccaggctggagtgcagtggcgcgatctcggcccactgcaagctccgcctcccggggttcacaccattctcctgtctcagcctcccgagtagctgggactacaggccccggccaccacgcccggctaatttttttttttgtatttttagtagagacagggtttcaccgtgttcgccagaatggtctcgatctcctgacctcgtgatccgcccgcctcggcctaccaaagtgctgggatgacagacatgagccaccgcgcctggccgtaccaatcttttaaattctccaagctttgctaatttgtaacaagaggattctctgtggtccatagataaatgcatccaccttcttgccgcgtattgtacgcaccccctacatcccatacttgaagagtaacattcaagtttcctggcaatgttatcccgctcaaaaaatatgtatatatattcatcactatagtttagttttattggttcccaaaagtttcttgagcaaaactcataggtcttccaggaggtgctgcttcaagcatgacaaatttcagttgccattcttggtttctttcttggggtctgatggagttcagtgtggtgctcaggctagctccccaggcagagggagaaggaaaggagagcgcctccgtaggtggggagagaaggaagggagcaggaccctgccctgggatctgggtgccctggagagatcaggggaaactagttgatgatacttttgttaaatgaaccagtactttcacatgcttttaagtaaaaatgaaatttaactggaaggacccaaatcaaacatggtatctcttgagttatctctcactatggatgacaaaggctgttgtcaaagttgatttcactcaattaacttgatggatattaaacaacctgtataagcccagaaaatgagggttctgggagatctgttattacagaaatgcagaggtgtcctaactcgtgttatgtgaaggtggccatgatgcagataaggacatggctatgaatgtgcaggctatagtttgccctgacctgggtccatgaccgtgccttgagggtggaagaaacaccagagcgccctcagataagatggctggagggcatgacaaaaaccatgaaagtaagaccagaccgtgcatgcaagatgaatgctggcatctggctgaatagaggaatttgaacaaacaaaatcctttttctgcaagctcttcacataattctactccacctggagcttcatggctgaaatgagtggttatctatattcaggtctagtcagacgtgctgattaattatagttgatcagcatacatatatcatgctttcttacatatttaatctatcccatgtatacataagattttgaaggataaattatttattagcattaaagtgtaaaatttgcttgataactataaaatgccttaaatacactagtatgagtttcgaaattataccaaaatgaccaatgtgaagggtagtgttactacactgggtatgtcctgccactacgtcctttaggagatttctatagcatcacaatgaagtccacctgtgtgtgagagagaggcttgcgctcgccttccttaccagcaatgcaaaagtgctcaggggacccagcttggtctgagtacgaaaacaaacctaagaggcttcaaagccagctctcctgtagtatgtgctcacatccctgaaagaaaagcaagaaaattccaaactccagattttctaatataagctctagtgaaatacttacctttcttgagtcaaagcagaagcaactgctaactagaaatgtcagcctgctgcctcagagaatttctatggctgttctggggtgaagagggtggagtctttggctttcttaccacaggtgatcaggtaagaaggaaccacagcatcctctatgaagaaatgctgtccgaggtgatacctggaatccaaagcttttctaaaggagacctgggaggggactccacacccatcaaccaatagcagcccagcccaaaggctgcaaatttgcttctttctgacacccagtggagaaacaatcaccagctcttttccagcgagtccagcactgtctgcaattggatttgctttagttgcaaggattgtaagctagttggtgtgtgtgtgtgtgtgtgtgtgtgtgtatgtgtgtgtgtaggtgaagtttgagacacctggtgttagtgtttctatccagttgtactaaaattggcatgaaatttcttatctagaatttcaagcctccagctgtgagccttattcagctatcattgatttcatcaccaaaaaagataaaaccaggaaatagaatgcgtgtgagagagtccaaatgattgtttcttttacccttaactaactccctttccttagcccctctcctgcacctactggttttctaaggtttattcccgcagtctttagtaaactaattttaaatgtgcgaatggggtgaccaggttagagactcccagggaagaaccatgctatgtatcccactaataagttctccttatggagctaaagtctttcactggagctgtttccagtgtaacttgatgtagcatttgggatagtctcatcgtggagcaccaccactatcccagttggccgatacctgtttcttctaagaggagaatcaggtaagttttcccaaagcgccttagggaaatcgtgccattcagagagctgcgttgtgctcatgcatctggaaggtcttgctgttcatgcactgactcttctaactccatatcctccattcctgggtgtttgccagcaggatggaatgatggctcactgaaaactgaagaagacatggaagacaaaaagggagatgagaaagtcctgcccattaatgataggaagatgggcacaatgcggtgacctcacaggtctccctgtctcagctcagctctgatgaagagactcatgtcatacagtctcttcagatgatcacagagaaaaacgtggtgacagagaggcagatgttttactgtttccacttctggaacttgttgcagggtatgaagagggtcagcaccagagaagatacagaatatcatgtctgcaatggatgaagccatcaaaggatggcttcacttcaccaccaggcagcactgaccaacttatggcaataaatcccgcagaccagaattgcacccatcaaatgcctcactcaccatatgtcagcccagaagactcttgcagtggtgagccagtctctttatccaccaagcctgacccagcaggcaggagaggcccagtaccaagatgatcatccacaataacctgcacactgcattgaggatggaggccagccctaacagcccgcagccctcaggagggagaggcagtaaagggctccttctctctttgtcctgatgaatgggcattgcactagaaagatgaacattaggagcagattatcagagcctcggtccagccaccatctcctctatgatgacccagatgggcaaaccttctgaaggcaaaggtccaaccaacatcctgggtggctggcattttctgaatttctatagctcatcacaaagtgcagcaggaatgggagtatttggtgcactttgattttgcagttgcctctgatggccaagagtcttagggccaaagatttctcctgacccaaggtccaggtcatatttctgcagcacagctgtgaccctcatcccaactacagccactggcacaatctccagtaatatttgcaaatgattatactcacatcaggttataaaagcttgttgtttttaatttgagttatatttttaaaatacaaaaatgtcttgttttttatgtttgtgttcatgtggtacattttccaggataagatgggctgtgcggtaatggcaaataaaccctccaaatctcagtggctggcctcctctaagtttatttcttgctcacggggtctgccgtgagaccagagtctctccagagcaactccccttccacccctgcccaggaaatagaacatgtgcgtaactgagagacaaatcatgtagaaaaacaaggtgattttcctagagaaggactgaagtgctttgctagtattagtcactatgataaaaagtagagaagaactattctatttctttaaccatctaagagacagaccattcacttggagtgaaatatttaaactatttcttcatctcttgaattaaaagaccttaataatatgaattcataactcgaatatagataataaacccagcacagtttggcacaacaatttgtatttcctcttgaaataccaaggctattttctcatgtaaattatatacgtatctatatacatattttcaaggactgaaattaattttaacatctttaaaacaccaaatagtatcacattacctgtaaaatggctggttacctcaaaggcagcattttaacatccttagctgctttaaaagattatcagcagtctatagcaaatattacatgagacatttaaagaatggtgcttcatttcatcatttaaaaatcttagtcaagaagagacaagaacaatttcttagaatcaaagctccttcattgggaaatcattcatcttggaaaaagcagaaatattttggctaataaaaaacattttattactaaattaacattgaagaagttgtaaaaatctcattttgctttaatttgttaaagtcaaagccttatatgcacctttgatttttataaaattttaactctttgaaaataaaatattaagcatcaaaagtaaatagaaaaaattaaaaataaaatgaaaaccaatgaaatggaacacagaccaataataaaatctgtgctgccaaaagctgatgctttgaaaagattattaaaaactgcaaaacacctagcaaaaggaaaacatcaccaatatcaagaatataaaatgggacattattatagaccctagagatactacaaggattataataatatgtatgctgaacaacttgaaggcaagaaatttgacaatttaaatgaaaagcatgcatttcaatttcttatggtatagttacttgcaactctggagagcccacataattcatatagtagccatcttctagctttgtgggttctctgtaaaaaagaaactggaagagtcacagtaaacgaacgacatatactttccacccttacatgagtagagaataatctgctagagcaaatgggctgggtgtgggggctcacacctgtattcccagcactttgggagtccgaggtgggtggatcacctgaggtcaggagttcgagatcagcctgttcaatatggtgaacccccatctctacgaaaaatacaaaaattagcctggcgtggtggcaggcacctgtaatcccagctactcgggaggctgaggcaggagaattgcttgaacccaggaggcagaagttgcagtgagccgagatggacccattgcaatccagcctggaaaacaagagggaaactctgtttcaaaagaaagaaaagaaaagagaaaagaaaacaaaaagaatctccaaatgctcaaataaactctatataatttaaatgtgttttaatttttctcttactgttaggaaattgatattttaagagaaaacaactagtcagtgattgtttccaggagaactccattttgtggaagctcctctgagacctaaaccctttaggggagctcctgggagagcctgagcttctcctgattcaggtcccctttgtgtgttcactaagagtctgctctttgccgagttttgtaacaaggttgttgaaaatggaagagtattttcagccgtgagcttactttgcaacattcagctttctttagagtttcaggaagttcgtaattgtcttataatgaacaagaactttcctataagaagaactacaaagcatgccattcagaaaataggtaatagaccttaatcccaggaatactaaatattttaggaagtctctaggttcagaaaaacccaggggccctgtggactgaatgccaacctcccctccctcccccctgcccccccgacccccaacccctctcacctccacagtgagctccctgctttcaggctcaaccttctaaagttctctttcctggctggatgagtctcccatgaagccccttccatctctccactgctcagagctctccagaactcacattgtgatttaaatccagggtttacttactagtctttacttactagtcaaagccccacatgcttgccctgaaatccctctagttatttagtgttagaaactcaccactaggaccattattttgctgttagatctatttttgggggaaatgcctaatgtcaggatttttttttttttgaaagagtctcgctcagtcaccaggctggagtgcagtggcgcgatctcggctcactgcaaccttcacctcccgggttcaagtgattctcctgcctcagcctcccgagtagctaggactacaggcacgtgccactatgcccaactaattattgtatttttagtagagacggggtttcaccatgttggccaggatggtctcgatttcttgacctcgtgatccgcccacttcagcctcccaaagtgctgggattataggcgtgagccactgtgccagaacaatgtcaggattttttggcttatctttactgacctggtctaatccccacagatgaatatttattgatttatttttttctctttttggaggaaggaagccctgttgtcagcatcctaaaagctagaaatgagaaaagctgggaatctcaattttcagtgtgtgctttgttttcaatattgtaccctttcctcaattggtctcagtggtctccagtccagagactctctgttttatcctctacggaaaatgaacattttgtcctttatacagaaatggacatgtggggccgtcttcaaccactcctaaaacactaaaacagacattcaataaatcctgtttccagccccacttaatcctccaagttacataactgcagattgcagcgctcacatagggaaccctgtgagcagcctcctttgaagctggtcatccctccagccttattcccccacactctcaacggtattgtaactaaggacctcagtttttaaaatatacttcagtcatccactctctttatcttccttcctgccgctctcacaccttgattaaaaccattttttccttccacccatccatgtctcttgactctggcttttaggtggcaagctgctggacttaggaccagatacagtatcgtatgtcatgagcctttggggagctcttcagtttacaacttggtggctcaaagatttcctttctactgctttagacagctttttggggggatgtgttttccgaaatcagctgctctttccgtatagaaccatacattgagattacatgagtggctgtgatgtctaatgtaacagaacatttgattctctttgtctatattgtttatagaaaaacatctcttctcattgatatgtttctttccccttccatctctgttactgtactaaccattaccagatctttaacaataaatttaggattttaaaatatatttgtggcaggaattactgtctgcctctagaggtaacatttgagtgaactgtcttattgtcattggcaacttccttcagatcatgccactgcattacagactggtcgacaagagtaagactgtctcaagaaaaaaattaaaaagattaaaaaaaaaaaagaaacctttctgaggtaataattggagacactggcaaagacatgtgacagagttttcactttcttttattacaaggtcaaagtatagaaatacctaaatattgaaccatggagagatgattgaattgtacaatattcctatgtatggctgattgattcagttagaactttactcacatattgaacttcaaaattttcactcccccgaccaatgctttttagccttctattttactttgcttcttaacactcatcactgtctaatatactatatttttcttgtttatggtctgcctttcccagaatagaatcttcatgaaggcagagatttttgtttttatttcgttcattcatctagctccagtaattagaaaactatactgcacatggtaacaactcgctaaatatatgttgaatgagtcatcaatgcttttctcttaacttaatgacatgggaaaatgtccataaagtatacaataaaatatgcagactcagaacataaaaaatatacacacactctcacacacacacacacacgacaaaatcttgacttcagggtgttctgctgaacttcagttgttcttgacttccacatgtggaggtggagcatctttgttaagtttataagtaatatgtttttttttgtttatgaaatgcctggttatatgtttcctttgtccagttttgtattcgtttctcttctgatttgtataaattcttcatattccataaacactactcctttttcataggtgttgcaaatcatcttctttccactaatggcttctattccctttttataaagtcttttgataaactaaaatgttaatattattgttgtaaaatgaaccaatgttttacttcatagttttgtgttttgggtatgaaatccttgtccactggaaggtataaactacttcttcatattttttgaattttaaagttttttattttttattttaactcattagaaattacgtttgtttttttgtgtccagtgacaggtaggggtccaattttatattttttctcatctgtaactaatgtcccagtaccattaatatttagagttgcccattctttcccaatggacctgaagcagaagatctcatgcactgggttcccttataattcggctatttctacattttgagctgtttgtctttcttatataactctgtagtcatgtaagtagtcttatgtatggagtctcccttctgatggagttacctaccccactgatttttttttaggctttctctttactaataaatgtatttacaaatacaaaccaccttctaaagaatgctttagttgcaccaaacatatacaagctttgatatgtagtgtttttattgccattctgttctaaacataacttcattttcttatttcaaatgtatttttaaatttcgcaaagtatagtatcttgcgatcttctggttaacaaaatctatgttgtcaaattgtggtctaagaatatgatcatattaattattattattactattttttttttgagatggagtctcactctattgccaggctggagtgcaatggtgccatctcagctcactgcaacctctgcctcctgggttcaagcaattctcctgcctcagcctcccgagtagctgggattacaggcacgtgtcaccacacccagctaatttttgtatttttagtagagacagggtttcaccatgttggccaggatggtctcgatttcctgacctcgtgttctgaccacctagccctcccaaagttctgggattacaggcgtgagccactgcacctggcccgatgattattatttattgatacttgctgtggcctagtacactgcaatttttataagtgtttcatatcaacttgaaaggaaagcattttttgtcatttttgagtattatggtctgttactacccttttcataaaattttcataaatagtgttttcaaatatccttattttgagattttgtttttggtttattgctcaaccagtatctgagggaagtattatttaattgtggcaaaatacaacataaaatgacaattttaaccatttttaaatacaattcagtagtgttaagtgtattcgcattcagaacacaaccagtctccacaactttttcatcttgtgaaacagaaactacatccattaaataacttgtcccctccccacagtgagagaggtattttaaactgtctctctggaatatctgttcacttatcatgattttgtcaacttttacatcatatgtattgaggctttttatatgcataaaggtgaactttattattacttcttactttataataatgtattattttaagcattttaagtacttacaaagctgattatgtatatttagtctctaaatacctgcaaggaataagtatagtgctttatttctaaggagaaatttctgttttcacctagagaatagcaaagttccctatcctttctctctttaaaaaaatcagtctactgtttgaatgtgccctattttctatgtgctggctgggtgcaggcatctctattcccattcattatatcacaaaggtcaaaggctttatctctgatatctgcaatgctatcaacaccccaaactctaaatacagagaatggaaaggagaattgttatgtattatctagtgtctctaggtgtttctaattacaaaagttgggtgttgttgttaattatcttagccagccacctggatgaattgggatgtctccatgacataatattaatctgaaaaaatacagtttgtcgatagcatttactcagtgattccagaaatgtatactgtgagcccaccatgcacatgcttatggaagtccataaatcattctgtccacttgaagcatcatggttcatacatttgggaagagggctctatttctaaagcaggttaccacaacctgcaggcaggacgcagaaactctgaacctctgaactgagcagaaaataagtgtttccagggagggaggaataagaaaggctaacgtgtatgtaacatgtgtcccatgttcactttggggtggagacatagcatttaaatgtatttcagttaggccttgtacatcaaaaggtgaagtggaggatatgaaggcgcttagtacacagcctttgtagaccagccagagccatgctgtggtgggtggtctcttattgggaaggaatgctggtcagtttctgtgttaaagctgcaagagggaggacaagtgtcaggcagttggttgaaatcactgggcaagacttttgaaagggctggtttctgccttcacccttagggaagaaagcctaatggtggttagccattctctagagaaaccttaaaaacctctggttcctttgaccaagaggaagtctgttcagtcaagtggggggcttaggattctctttatttctcaatatataagtcctgcactcatggcctagcatgatctagcaaggattcagtgtgattccactaatgacaatttatttagtcctaagtccatgtgtatggacatgtaaatacatggaagactgctcagcaaaatattggttctgtttatctttgatatcttggtggtagtttcttggtggtaggtagtttcttcttcatgtctttccaaattatttttattttgagggttgtatataaagagaatattataagcaaaccaaaaaatgcaaatagtatatatataaaatgaaaaataattcaaaatatttaattgctcatgatgtcataaaatggtagactctcagtgagtgcatatatttccttaacatgaagttattaacatatggtcagcattttcatttcaacttaatgtagtttatagttctcactatctaaattgacatttactttaaaatatagaaaaagacttctcagatgataataatggtaaggttaattatacataatggtcccattctttttttctgtgaaccaatatgtgaaatcaatgactatcttctctatgaaagttttaggtggcttagacaatgttcatgctttattagagtctcatctcgaatgggcaagagcctgcattgcttaggttagtactggacgtagtgaagtgatccatgccacatagatgcataaatcattttgaacagctgggcagtttcaggaggccaattaatcaagtggaaaccaggtgtagaggccaatgaaaagcttcccctttgccctctgaaggtttgctgaaaaatcaactcaaaaaaggtaaattaacaggagaaatggcatgcaagtttattagtgtgcacaaagagaatcacagagtgattgtcaataccttagtggggttcagaagcctgtataccatgttgcagaaggggaatctcagagaaagcctggctgtttatttcacctatatagattttctgcacagatgcaaatctactccacgaaagtcagcttttctgcactattcctgtctgctggccttctgaatagccacctcaagatacatcaaagaaatatgttttggggtgaaattttttggtttcctttagcaaaggaaaggtttgtatacctttactccttttgtatatcaggcacccagccactcgctattgcttacctgcaccccatcctcattccagagagttatttcctgcttatatatgtttccttgaactgccataacaaagtaccatagactaggtggcctcaaccacagaaatttattttctcatggttcagcaggctgggaagtccaaagttatgttgttttggccagttggtttctggtgagggatctcttcctgtcttgtagatggtcaccttctagctgtgttctcacatggccttctttaactgtatgtataaggagagagaaagagagagagagggagagagaacttcaacaatctgacccctgctttgagcctcatactttgcatatgactcccaaatccatatgcacattaataaatgtgtatgcctttaaaaaaatctgcctataatcagtttgttttataggcttcataaaaagccaccaatcctatcagattagggccccaacctaatctgatggggtgtaactttaattacctaatgtcactttaattacttccaaatgtagtctaaatgaattcaggtcatagcaattcagtccatagcttggcttaacctggtccgcagtcacaggtgaagccgagctatggactgaattgcagcccgtccgaattcatatgttaaatccctaacctacaatttgactgtatctccagtgtagccaaattggaggttagggatttaacctatgaattgggacgggctgcaattcaatccatagctcggcttcacctgtgactgcaggccagctctgacccaggtaaacagatagacttctctgtaattcagtaggataaaacaccttctccaataaagtcttaactacagctttggggaagggcttctctttccaagttcgttcttccttgagtaatcagctctagattaatttatagagttcactcatatcctatagttaatcttttatcatggcataattctttatattaaatttctgttgaaatcactctatggcttttatcttctgatttgacctacactgctacaagaacagacaagctgagaagcatgagcttgaaatataactgcccctggtgttaataattacatttttgtggaatgtatctgttataggactaggtattcattttaattatacttgtactttagttttatttaattatacttgtattatgattctgccatgtaaaatgtaagcctgtgaagaaaatcaaaatatttcacccccaaatatccttctttgacatcttttgagatggctgttcagagggtctgcaaatagaagtagccctgaaaagctgtctttcctcaggagggaggtttgcatccatagagaatctgccttgatacagccaggtttctctggggcccttcctcatctgagtctagtctgacacctttaaacttctcaaagaaacatttaccatctattttctgagagggctgctacctgtgaggtttcagctacataacaagaccagctttgctgccaggcctcctcttctctccctcccataacgtgtcccaccaccataacttgatttaccaccataacctggttttggccgtgctctgagctgccattctttctgtagcctcgaaatggcatacaaacttcaaccatctgaccctcgctttgagtttaatactttgtatgtgatacccaagcccatatgcatgttaataaatttgtatgccttttcttctgttaatctgcctattttcagtttgttttataggcttacattatcaaaacttcagggggaaaatgtaaacttccctgcaatgccagtgcagcacaaagcttagagcatatggtaaccctgacaggagggccgctgcatcggggggacctcacaagacaagtctggaaggtagggacaagcaggcagagggaatcagggtggcagtgtgggcaagagacctggaccacatagcgtctctctcaagagggctgcatgaaggtggtcactaggacaggctaggactgaggggtggtgtattttgaacatgtcgctggggcagaatgacgccagatgttctcatacccacactgctggcccgccatgcagcagctggaaagagcagaacagccttctttctgcttactggtatccttactggtaagcagaaatgcttaaagatgcctgtccattagtacagaacatatattgaagactgcatttggagagcagaggcaataaactgaaaactagcatgattctcttagtcacattttacataatagattctaataatttaagactttttttgtatgtgatttattgtagcccatgtgttacaaaggatctgagaattagacactttaattgtaatatattactaactttaatatggaatgttgttaccccatttatgggagtgaaatatgcttaaagaaacattacaatgtgtctaaagtaacttcttaaacttgcaaaaatcagagtggatatgccacataattgcactctagtgtgaaaatccagagatacaaagcaggtcagacaccacctgggataagctttcacctatcctccttttatgatcagaaattattttgcaaattttgcatttctacaaaattatcttaggttattatctaaattcaccatttaagattcaccattaaaaaaaatttctgggctgggcacaatggctcacagctgtaatcccagcactttgggaggctgagacgggcagatcatgaggtcaagagatcaagaccatcctggctaacacggtgaaaccccgtctctactaaaaatacaaaaaaatttagccgggcgtgatggcgggcgcctgtagtcccagctacatgggaggctgaggcaggagaatggcgtgaacctgggaggcggagcttgcagtgagcccagatggcgccactgcactccagcctgggtgacagaaagagactccgtcttaaaatataatataatataatataatataatataatataatataatataatataataatataatatagtataatacaatataatataaaaattaaaaattctgataccttctaagggaggaggatgtactatttgttctttaaattctcacggtatttccacattagagtccccaaatacaagagctctaatgagaaagtgactgctcagaaatttgggcagacgttttatcgttatgccttcatttctttcattgcttaataaactctaatggataatagtgaacacatttctatgtagtttctgatcaaacgattctgtgaaaatttagtcaaggaatcaagagaaagtacagtcatttctccaaaggagcatttcaacagacatttcatcaaaaacaaaatttaaaatggcaacctgtgtgaaacactttggcagaataataataataaataatttggatgcgagctgaatacatgaattattttactggggtggaggatatgggcattgcatgcttattacgtttttggtttgtattgccctacatgttctttaatgtcctagtgttttgacaaagacaggcataaaatgagcactaatattttagtttctgtcttctttttttttttttttttgagacggagtttcgtgtctcacccaggctggtgcagtggcgcgatctcggctcactgcaaactctgcctcccgggttcatgccattctcctgcctcatcctcccgagtagctgggactacaggtgcccgccaccacgcccagctaattttttgtatttttagtagagacagggtttcaccgtgttagtcaggatggtctcgatctcctgacctcgtgatccgcccgcctcggcctcccaaagtgctgggattacaggcgtgagccaccgcgcccggcctagtttctgttttcttaaggaaatagaccagtcctttgcaaacacatgttttatttcctagtaaactcatctattgctacaactgtgcaatttaagggacaaatcattcttccttaatctccgttgatggcaattccatctggtgcccaagctaatgactttgggatcaccactcttcttctctcacactctacatccagtctggaaagaaatcttattggttctatcacacttacaaaacctatcaaaaaccctaccactgattaagaactccatcgtcaccaccctgatcaaagccatatttttctctttcctggaccaatttaacggcctctggaggaggactggcccctagatggcctcagcggacccagctttcttctccccttccccatttcctggcttgcagttttagaataactgtagaatgtgctaagaatgcagtatcttgatatatagaggaactttccagaaaagcctgggctttgtcctcattccttgtagaacgggatgtcctataatgcttttgctcagtgacccacccacgggatgccctcgagctaaaacccagagcggtgtgctttcagagtccttcagctgtagtgcaaagtggagcatgtgtagatgagtatatattctctttataccagaagtaagtatagtttcattcagtgaaagtcactgtccctaatctatacaatactcaaagtttaaaaaaaatactctatgttaaaaactgtgagcattgaaagctgacttatctattcagagatcacatatagtaaagggtattacagtataaaataccaagaaagcagatcagctgatgaaaattactgattttcaatgtctttttaatcattatatgacatcctgataagttttcctgaggaattaaatgcttctgggatcttaaagtacattttctacaaacaagtcatagtgttttcttaaaataagctatcaattaaagcaagaatgtggagtagatggcattggtagatacaatcaactaaaacattgtttttattttcactccagagtacggtgagcttatattcacaattagtaaaaggaagcagagctgattttctacaacttcttctgtttcttctctcaaaatcttcagagagaggaaaaggcaaaggaatgcagtattctcccatttaagtcaacattacaaatgcaattaaagggtgtataatattgctaaataagacctcatcatgatgtgtattctatgacagtttattttgactcctttaactgagcgttgtgtgagtttctttagtttatttgttagccactcggttacgaagatcaggatgtttttagctttttagacacaatatttgtcgaagctcttcttctcatactatacttttctaaaatgaatgtgaaagtattgaaatgtgttatcgactttccataaaattctcatttacttgagcctatgtaaacacctgactaaacacacggctattcactgtcaggactttctcctcagcatctgccacggaaaagattcgattgcacgcatacgaacccaatgccagcaccccaagggacagggcaatagaaatgggaggggaatgatcaagtcaatgaatgatacactccattaatcttaatgttaggacattaatattgcttggcaactgcctaaaatcaacaataagcgatcaaccaatttgttgcctaaaagttattgatttaaccatcaataacttaacagcataaccataacaataactttaattttactaactttaaataactacagttctttaacaataacaataacagcatatatgtacatcagttatgcattaaaagatggatattttttgtgtacatctgaatggagaatattagataatgtagaaagacatgagacaaagttgataatacaatcccttagagctttaataaatgagctctctcagtcaagccacagtaacgaccttttctctgtgatatgagccaggactctgcaggtgtacagaggagataaactgcaattataaagtacaattaacaggtagtagcggtctcatttattatacacacctacgcatgtttccaagccagatgatcactaagtattcacagcaagtaatcacccactggacaaaacagcattacttcaccttctgaaaaagtagtttctactactttgaaaagcttgttggtgatgagacgaaaactgaaataggttacaattctaatagacacacagtacaggtaacacaaagagtctttccttatttaacattcttaagcatcacccaaaataccaaaaagaaatacggtaagtttcaaggttttgcataaagtactacactgagcttttaaagtgaagggcttagtcacccaaatactgtcttaggccttatagtatctctcctgagttcccagtatataatttattataccaaacagatcattctccagagttcttttgatatttctagatctctctcaacttataacctaatcagctccctcaatcccacataggcctcaagctaatctcaatcactcttcttccattcatttttcattcacttatttacaaatatgtattttgcatgagttgtctgccagcactgatttaggggcagaaagaatatgatagtacctaagaaagaccctcattcttatgtctctttaaaggaagataaaaacttttaacaaggtaaatatttaaaaatactttaaaggagaccaggcgtggtgactcatgcctgtaatcctaacactttgggagggagaagtgggtggattgcttgaggtcaggagtttgagaccagcctgggcaaaatggtgaaacactgtctgaactagaaatacccacccctaaaaaaaattagccgggtgtggtggcacgtgcctgtaatccctgctacttgggaggctgaggcaggagactcacttgaacctgggaggcagaggttgcagtgagtggagatcatgccactgcactccagcctagttgacagagcaagactctatctcaaaaacaaaaaacaaagaaactttagaagacacaaaatgctataatagcagagagtgacaattgctacaaagaaaataaaatatgattatggaaaacaaatgaactggttgatccaactcctgtctgtgtccactgctaccattttggagtgagctcttgttaggtcaccactcacccaggctccagtgataccctaattggtttccttctgttaatggccttcattgttttttctgcagcgcattcagtctgtcaggttgggttctatagaagcagagcatgcaatagcaattattgagcaacttttcttgagagaataaccttatgagaggggaatagtaagtagggtgagacaagggtgagatctacctaagccaggatgatctcaacacaagactggctcagcctgacacccagagttttggagcatggattgcattacagagttggcctgacgttgaggctagaggaatagctctttataccatgtgtcagtcagtcactggctacaggttgtccaggtgaggcagctcccttaagtctggagaagtgctcaggagagaacagggcacttgtgagcccttagctaccaacaatagtatgggggggtgcaatgcagaggcctagtaaagtgggactgaatagagcagcaccctttaatttaaaagaagaagaaaatggatattgattagaaacacagcagcatctgccacagttagaaaaagcatgactatgtggtgtttctgtaagaacatgagagaatgtcagtgaagcacatcataacagtgattggagcatgagttctcagtcaatggcagttattttgattgtgacagagattgagatgtttataacttgaatagctggcactagaattcctattacagaagaattcctaacgttgaagtactagtttgatgagctgcttgggataaaattgaaacttcaaagttatgcccattggcaagagttaaatcagcaaagggggcaccaaaactatcttgtgtgagaaaaggagaccaatttagtttttgctcctgagaagagaaaagacagaagagaagggaggggaaggagggagatgcaggaaggagagccagggtcatgccagaaaagctcagagggaattagctggccaagcagtggggaattaacttttaaagaatataaggcttggcctgggtgcagtggctcacacctgtaatcccggcactttgggaggccgaggcgggtggatcacctgaggttgggagttcgagaccagcctgaccaacgtgaagaaaccccatctctactaaaaatacaaaattagccagatgtaatggcacatgcttgtaatcccggctactcaggaggctgaggcaggagaatagcttcaacccgggaggtggaggttgtggtgagccaagattgcgccactgcactccagcctgggcaacaagagtgaaactccatctcaaaaaaaggaaaacaaaacaaaaaaaaaaaaaaaaagaaagaatataaggcttatgtttacagtaatttttgttacacctccatatcttctgtaaggttattgaaaataaactaatgggttatatgtatatgtgtctttttttggtgaaaattgagggagaaaataaatcttatttatgagttaggatgtttgaatcatagagaaagaataatctataaagtgaagaagttggaattctcagccagaggtgactgtactatctggaatatcctgagaaacagaaccaatagcagagacagagggagagcgagaaagacttactatagctaattagcttatgtaattctggaggctgagaagtcaagtttgcagttggcaagctggagacccaggagagccaatgggagagttccagtctgagtctgaaggcctgagcaccacgagagtcaatggtgaaagttccagtctgaaaactggcaggctcaaaatccaagaagagccaatatttcagtttagtctgaagacaagaaaaaagtcatgacccagttcaaacagccaggcaggagttttctctttcttactggaaggtcagagtaattttagttctattcaggccttcaactgattgagtaagggctactcacattagggagagaagctcgctttactcagtctactgattcaaatgttaatttcatccaaaagcgccatcacagacatagctgggataacgtttcattaaatatctgggcacctcatgacatcgtcaaattttcacatgaaattattcatcacaagtccacctcttgtcaacttggcatccatgcacatctccttaaactatacttaatctctaaataaagaaaatagcaaggccatgcttctgtctaatatatcatcatcccatgtacaactgaagacacacctaccccttccccagaaaaggaggtataatcctcgaatgatgtttacttttctccttgatatcctgtaacttaaatgttataatataaaatcaacaacacttaaatgcaatgatatagtcaatacctcctacattaaattataagggaataagacagcagaaaaacaataatatttgcttaatgcacccacacacatttgcatgtattcataacaaaaaaggaggaaatgctgataacaatttcaatcttgatttctgtaagtggtcatgtggtcatagctggtatttctagctaccttcttccactaagcacctcacttcttccactaagcacctcacttcttccactaagcacctcagctggtcgtgattatttccttgttgggatgacccaaggcttcattcctgaagggtctgggccattagttgtcctgcctggattaggtggttgtcattttccattgaccataagtacagaatattataatcccaaggacaccctaagggtatatatattgcagacacacccttccttatctccatttggaagtacgagtccaagttccccttgccagttaagatcaataaccagaactagcccagtaactctcttccttgcctattgatttacaggcatgaggaatccaaagccactgggtaacagttttaatttccagttctaaaaaggcactgttgtgtctcttggaggaagcaatccttcatttgaaacagacttctaggccagcagatcataaagttgtagaatcaagaggcaaacattttgctagtaggtcactaggaataaccgtgagtgagaccactcccactttcttcccttgattcctggacctgtgaattctgccttttggagaaacagcatcatattttggatgctgatttaaagcatacagactcctgaggattctttccccagctcagtactgccacctggctgacactgtaactgagtctgcaaaaggccatttcatcattctaccaaaccagctacttcaggatggtagaaaacatagtaaagtcggtgaattccacgaacatggacccattgctgcacttcttttgctgttaactgaattccctgatcagaagcactgctgtatggaaaacaatgactgtggttaaagcattccgtaagcccatggatggtagcttgggtagaaacattgcatgtagggaaggcaattctatatccagagtgtctattccagtaagaataaaacactgccctttccatgatgaaagtggcccaatgtaatcaatctgtcaccaggtagctggcttattaccccaggtgcatatcaaggattcagagttggtctgtgttgcaggcatactggaccctcacagtggccatggccaggttggccttggtgagtgggagtccatgtaggctaagtctccatcctgccactatggatactttgttcctaagtctactgggagatgacagaagtggctggcgaaagaggctgataggtatccacagaatgggtcatcctatccacttgatttttaaaattcttctctgctgaggtcatcctttggtgagcacccacatgggacacaaatatcaccatggttttgtcactcattcagagaggtccacccacacatacctctttcccaggtttccttgtcaccaatcttctaattatgtttacacattatgccatttgttctttccaagcaaagtgaacaacctggtgcactatttgaagttgagtccactgggacaacttctcttcaccactgtccagggatgtcccagagaggggctacagtgctgcagctatccactttcagatggttcctgaatattatgcaaaaccctctgtaatccaggcccaagtcttctcttctttagtcaactgataatggggagctccccatgggaccataggtgcaggctgcgagagaaaggtcagtgtagcagatgtggggaccatgggcttttgggtcactttttcacgtaacttacttgtgcttcagagcctgctcagacctaatcatgtgtataccacttccattagatgctggagtgctcctctgcatgcctagcttcatagcttggtgaatcagataacacccagctcatcacatgcagctcagatcacatggcaacttggtggcccagggttacgagttctgtaactactaaggtctagtagcaggccaagagttgtttctcaaaaggagaggagttattcgcagaagatggcaggactttgctccaacattctaaggccctgcgctgttactcacttatagggcttgtcaaagtctccaaacagtatcctatctgccactggcacttcaagcaccattggatctgctagatcatacggcccaagcagcagagaagcttgcacagcagcctggactgctacagagcctcctcttattctgggtcccactcaaaagcagcagttttctaggtcactcagtagatggctcagagtaacacacgcaaatgaggagtatgatgcctccaaaatccaaagaagtccacagggtgttgagtctctttttttcgttgtaggagagaccagaagcaacatcaccttaaaaggaatatcttgatgtgcccaacatcactggacctctcgaaattgtactgaggtagaaggccccagcattttagttggatttattaaccactccctgacatgtatgtcttaccagtaatgacatcagtgtaatggaccagtaatatcttgtggaagtaaaaggtaatcaagatccctgccaactaaattttaacatcggcctagaaagttgacatatctgtgaggcaggatagcgaagatggattgctggccttgtctgctgaaagaaaattgcttgtaatgagacttatgaacagatacagaggaaaaaaagcatttgtcatgtcaatggctgcatatcagaggatgtgttaatttattcaacgaaaccacatctgatacagcagctgcaattggagttactatctagttaagcttactgtaatctgtcattctccaaaattcatttgttttctgcacagttcaaataggtgaattgaatgggggatgtggtgggaatcaccacccttgcatatttcaaatccttaatggtagcattaatgtttgcaacctctccaggaatgcagtactaactttggtttactactttccaaggcagagacagttctagcggcttccatttagcctatctcaccataataacccttgtcccttacacaagttaaggaaccaatgtagggttcttccagcttctgagtatatctattctaatcatgcattctggaaacaagaaataagcacaggatggatttcgggactcactgggaccactgtgagacagacatgggataaaactccctgaatcacctgatctccataagtccttactttgactggtgacccacagagggggtttaggtgtcctggaattagtgtcagttcagggccagtgtccagtagtttctaataggtctgattatttccttttccccgttgcatagttaccctgctaaatggtaccttacttttggggaagttgtgaggaagtttaacagtgtaattttttttgcattgtatggtgctccttcctcaagagtacttggcctcccctccagggggttctggggctataaactggctctaatctgggaattgattgaggagttgtgactctggtctaggttaaacttatattcacttgacctaggaattttctgcttacccagtgatacagtttggatatatatccccagccaaatctcaggttgaactgtcatccccagtattggaggtggggcctggtggaagatgactggatcatgggggtggagttctcatgaatggtttggcaccattcccttggtgctgttctcatgagagtgggtgccttctcatgagatctggctgtttaagtgtggcacctaactctctctcttttgctccagctttcaccatgtgacatggaagctcctgctttgccttccgccatgatcctgaggcctctccagaagcagatgtcagtgctcatgcttccttgtagaaccatgagctatttaaacttctttccttataaattacccagtctcaactatttctttatagcaatgcaagaacagccttatgtatacagagaaagtaagaatttagtagtcttccagagtatttcacctctagaaccatcatgctcaactaaccaacaccataaatctgcacaagtgagatgattctgattgctgtcttgagtctgcctcccttacaggaaccacacccactctcactttggtaccaccctttggctcctgtcatcctgggatccaattactcccactgtctagatttcccaaacagtgactgcattctccactgtaaggtctggcaatcacaaagctcttcagagacgctgaggctctccttacaaattgatttctcacaatagcagtgaaaagaagtacatcttctgttttctcccaatgagggtggttagatctgaaatggcaaatctattctaacattctgatctccctaagcctttgatgctttcctctacagatggtcccctttaagatggttcctgttgcaatggtgtgaaagtgatgcacatttagtagaaaccacactttgaattttgaatcttgatcttttcccaggctagatctgctgtatgacactctgttgcaatgctgggcagctgcagggagccacagatcccagccacccacaccatcacaagggtaaatgaccaatactcagctgcgtactgtgagtgtgctgtgttgccagtggtttttattttttatacttttaatgttttaattttttcttatttttcataagttattgggggtacaggtggtatttggttacatgagtaagttccttagtggtgattcgtgagatgttggtgcacacatcacccaagcagtgtacactgtaccatatttgtagtctttcatcccttgcccccctcccacttttccccccaagtccccaaagtccattgtatcattttacattctcaagcttcatcagaagagagagaaaccaataaccctgtcactataacctctccatcagccagcaattaattttagttcaatgtttcaaactttcttcaggctccgtgcactttcagctgtgtacattaatggttagtacccatacaagtattctgtttttcactttcagtatggtattcaataaattaggtcagctattcattactttattataaaataggctttgtgttaggtgattttgctccactatagaataagtgttctgagcatgtttaaagtaggataggctaagctatgatgtttggtaggttaagtgtattaaatgcagtttgacttgcaatgttttcaagttatggtagctttattgggatgtaaccttatagtaactagaggggtatctatacattcaaccaaggcaggtctggcatttccaacttactcactgtaggccaccttttggtctaggctttagtcaaccacagaaagtgttagagccctttctgactcctgagatgcacattaactgtataatctatgcttagtaaaagtaatttcagcctgaggtaagttggtgttcctccaccaatatctcacacacttaatatccattctcacatgtttcctaggtttctgtctgtataattttaaaaactcaaataattattgtagagtgtagcacacctcctcatgggccacactttatacctcacctttaggggcccgctgagatgagtctagttctagatccagaagcaaagaaagatggtaggcatggttcctgagaatattcagcattttcttgatggcagcttcctcaggggaggccactaaaatttcatcagtcactaagaggttactctcttcaaatgggggtagagaggctgctccccctggggctggggagacatcttccagcagaaaagaacttagtggttcagtgtttccagcttcatccaggtcttccctcacatcacatccccactccaatattcagattccattccttcccaatcaatgccctcactttccccataaatactctacaaggctgggagttcaaacttacattgtaattcagccagtcacaggatgagtttctgggcttcattttcagcaatcttagaactgaaattacaggagataaatgtctccttcagggcacacatagaagctttcagatcatttaggtagcatttgagctgggaattttaatcgttaagctcatctttctctttctatactttgtccagcaccattaggaacaatcagtcctaaactgttatattcaatagcttgtcggaaatgtttgaaattaccatatacacagtcatccatatccatgctttttgtaagtagttgattaggactatccaagggtgatattttgcatatttctattgccaaatcatgccaggtactgtgagtgctttctttaccactggaaacagaaccactagcatctttaattctaatcagattagaaagccaattctggaaacttcagaacaaattcaagaaatttattcttaaaattttgtttctctagaaccactgttagtactaaatcatgctaatctcagtactaatctgtattagtcacgtaccttccaaaagaaaaaaaacccagaacccactagatgctcagatggatatgtggacacataggtacatttattgtaagaaattggtttatgtgattacagagactgaggagtccaaaatttgcagttggcaagctagagacccagggaagttggtaatgtaggtccaccccaattccaaaggcctgaataccaggaaagctgatggtgtaagttccagtcccagtctgagtccaaaggcagaaggacactgatatcctgttcaaagactatcatagagaaacaattatttattactcaaactttcattccattcaggccttcaaggaactatatgaggtccacctacaatgtggagagcaatctgctttactcagtcatacctgggaggcttcaagacttccaagaagggtgttaaacttccttcagacatggaattaaattttgattcaattttatccaactgtcttgggaaaaggggaatgcttcacctactggatggtttaaattattttgttgtaatcattataaaaatatgtacatctgtggacaaaaagaaacaatgaatgagccaaatacatacttggaaattcacaaaaatgttagttttatatagacataatctgataagcttggaaattttaaaaaaatgcttttcgaataagctcagtgtttacaatagtcttgtttcttttacttgtcaaaggctctgccatctgaaagtattcaaaccatgagtttcatgggccctgcctgtgagaaaatgtgcattttccacataaaatccatttccttgtcagataatttacaactcaccctgtttaaacagactctgtatttaaagctagaagatttatcacgcagcaagttcaacctcaggaattccatataagtccacaagcgcatgtgtctaaaaactgttgagtaagtaaattcaatgatgaaaactgtaatttatatcaaggatgagaaatactctctttgtaggtctattgtcaatgactaatatatgaagaattaatgcagttgatcatctaaataatgctacacatgtctgtttccattggcctgtggacaagaacatgtgtcagtaaaaaaaagagttttgaaataaatctcagatattatgattgtttcattttctctaataaaatgtgaacatttattcattcttggaaaataattttgaatagaggtatattcaggtatatgtgttatattcctttgttaactttataggcattagtttcattaattaaatataatgtggctttggtggaatgaaaaaacactagcctgaagctgaactggtcacttttcagttttgtgtttggtgggtgtggacagacatgatgtaattctttggagaattgagacaacttgggagatttacagggcacatgtgattgtatttccattagtgaaattgtcacacattaaagacagagtaggcatattagagctaaaatgtattcaaaggacctttatcaaataaatgtcagttgtggaaataaatgttaagctggaatatgtgaaagacaaatggaaaataaatggagaccattcattcacggacaggtagagaaacattcagtgaaagctaaaaagattgaaatagggtcggctgggtgcagtggctcacgcctgtaatcccagcactttgggaggccgaggtgggtggatcacgaggtcaggagattgagaccatcctgactaacatggtgaaaccccgtctctactaaaaatacaaaaaaaaaaaaaaattaggcgggcgtggtggcaggtgcctgtagtcccagctactcgggaggctgaggcaggagaatggcgtgaacccaggaggcagagcttgcagtgagccaagatcacaccactgcactccagcctgggtgactgagcaagactccgaccgtctcaaaaaaaaaaaaaaaaaaaggaagtttgaaacagagtcatgaaaggcgatttatttgttttcagataagtgacatttagataacaacttgaaacgttgataggaaagttccagtaggatgggaatgattgaaagaacaagagagtagggaaataattgacaggagatgccaggaggtggacagagagcacaagtagacagattttactttcccggagggattcctcaactggattggaagggaaggcaacaaaaagtgactgggacatagcgtgattttaaaggcagaatacatcaaaatctgggggtagttgatgcagaagactttgaacaaatgtgaatatgtctttatggaatgttcccatcctacaccaatataagtgtgctgctaaaccagagagagctctctggaagggacttccttgctagtgttacaggaaaggggtccctatacagaccccaagagagggttcttggatctcgtgaaagaaagaattcagggccagtccacggtgcaaagcaaaagcaaatttattaagaaaataaagtggcgaaagaacagctactccatagacagagccgggagttcccaaaaggaagaagaggaacgcgtccaccctaggtacgacacttgtttatatataggataaataaagatcatgggaagatgtgctatgctacaagggtttgtgataaaggattaattttcttatgttttgcaaggatcgatattattatctttaaagcaaaattaggaatgcttctgttctcaagatatcaggatatcaagacaatcccaagtctgggccagtttagtaaacattatcaatctgttctcttagcagtaaacatctagaggctaggaatgcctaactttctatgaatgcagcccagcaagtcccagccttattttcttagccttcactcaagatggaatcattctggctggaaagcctttgacactaggaaaagcacaaattgtataagtggaacaatttggaaacaagtgtcaggtagtctttctttagacacaacacgactttgacataacaattgcaaataatgctttgcaaccatgtcaatagtggtatcttgaggggaactacagaatttgaaaataaatgtactctttacctaattactaattttttcatttattcttatgtcttacaaatatgattatatttatttaggaataaaaatttgtttcttaaggaattcatctatttttgttgtagttcccattggaaaacacatttttttttgttagaatagtataatcccaataagtgacctgtattcatgaaggctaagaatagaaacaagtaatggtagctcagaggctcaggttggaacataatggctctgcctcctgagaagagggaaggtctaatattacattagaccacatgtggcatctttatatttgctaagggatagttagtgcttgcatttctcaaaacaggcttacattatcacaatcggcgttcaactagttcaaaattcaagcttagtggatttttttccacagtagtcatgctaatgtaaatagcacatttgcagtgaaaatgttccagttttattcttaagatgttttagggcagtgcttctcaaattgtaatgtgcaagatccttatgatcatgttaaatgcagattccaagtcaacgtaggtgtaagtagggaagtctgcatttcaaacaagctcccaagtgaggttgtgccttgcatagtaaagttgtcgtttgcagttagatacccgcttaccaacagaaagtgaccagttaagaaggaacacatgctcaccaaatgcttatctcaataaatttctttacacagacttattaaaatcaacttaacataggatacacatgacacatataacatccctgtctttagaaaaataaattgattgtttttatgtctgacatatatgccaaataaatggaaaactgaagataattttttggttaaaatttggtcttcacattaaaattagtttgaagggtatttttctgaaaaaagaatctctctttctccatatatataatatttaacatttaactttaatttgaagtaacatttgcaagaaccaggctgtaaggtagtttccagggaccaaattgttaaaatagatgtttgtaatcaatacttaactgatgtgaacattttgtattatgacattaaagagggaattcttatttgaactctgcattagctgaaagttcagtgcattctgtagctttcatatgaatttcttccactacattaggttctagattttaatatttgtagagttggctgcatgcagtagggaaaatgccttttgctcttagaagtcatgagaactaaggggtcacaaggcgaattagtgcatttaagccagatttcatcctgtgaaatccagcagcagattttttttttttttttagccaaatttagttactttaagaaacaaagaatagaaattcctttaacaaagaaaattctgtctgttaatgtagttgacataaagataataagatattgaattttttaatgatttctttgagtctaggatgtgcccaaggaaacctgtcccttggcaggaaaatagtagacattttcttgaaattatcgactcatgcaacaacttggataaatctcaatggcgttatggtgagtgaacaaagtcattcaaaaagttcatactgtattgattccattatatgacattctcaaaggataaaactatagggatagaaaatagatctgtgattgccagtgcttggtggcataaggaaggctttgataaagaggcagcatgtgggaatttttttagggtgatagaaatgtatcttattgtggtgatcgttatatatatgtcttagaatttatagaaatgtgcaccacaaaaaggtcaattttactgtatgataattataaaaacaaaagaaaatagaaaaaagtgtgagacaaaaaatattaatttacctcagaaactaaatgagattttcccattgtatggagctgaggatttatgaaaattgctttcttccatatgcagccaggcatgaagctgacttgtgcctccattccctggaagaatccatcggagaaatggtggtaatagaagatgtgactctgtttgctggatttagatgccattacttcaagagcacagagtgcttcatgtagttgcagacagaaactataatggaaatattacttaacaaggtatcactttatatttcttctttctttttttttttctttttttgagatgcagtctcgctctgtcgcccaggctggggtgcagtggcacagtcgaggctcactgcaacctctgcctcagcctcctgagtagcttggattacaggcatgtgtcaccacgcccggataatttttgtatttttagtagagatggagtttcaccatgttggtcaggatggtctcgaactcctgacctcatgattggcccacctcagcctcccagagtgctgggattacaggcgtgagccaccgcgctcggccactttatatttctttgaatataatatcccaagtaagaatttgggattgtggaccgggcatggtggctcacgcctgtaatcccagctacttgggaggctgaggcaggagaatcacttgaacctgggagatggaggttgctgtgagccaagatagcgccactgcactcctccagcctgggccacagagtgagactcggtctcaaaacaaaacagaatttgagattgtgtttaaatatagtaagtacatttgataatcaactgcatggcagtcaaatcttaaattctaaaaccactacatctctgagtcaaaaagttgtatttgtggtagtagtctaaaagaaaaattctcaccaacaacacctcagggcattgtaaaaagtgttgctgattcttttcattagggtgataattgctaattaaagcctaatgtatggtggggttataagggctttctttccctccatgttggaataaaacacggtgtaaggacaaagctggtgtatattaaattagccctgatgcagactggctttccatattccgtataaggaatctgaggtttattttttattttatttaatttttttctgagatggagtctcgctctgtcgcccaggctggagtgtagcggcgcgatctctgctcacctcaagctccgcctcccgggttcacgccattctcctgcctcagcctcccaagtgtctgagactacaggcgcccgccaccaaacccggctaatttttttttttttttttctgtatttttagtagagacggggtttcaccgtgttggctaggatggtctcatctcctgacctcgtgatctgccctcctcagcctcccaaagtgctgggattacaagcgtgagccaccgcgcccggccaggaatctgaggtttagagcgttgaaggaatttgcccaaagtccaggcactggactgggttctcagcaagagaagccatgctgagaacccagtctcataactccaagcgtgtcttgacacagtcaggtactccctgctctctgctaaaggaagtgagtagttaccatcatttagtcatccactcattcaactagtatatatcgaatagaacttaggtgacaggtgctgctcctggcagaaggcgctgttctgttaatagatgctggggttgtttctctcattagaaatatattaaaccttgtacaaaaacaaatgtcttcctttgagtttcctttgcacttccagagtttagctaaaaatgcctatcaagtgaaagcagttttctgctcggaatctgcaaataaacgtggattctgagaattattattttagaaattaaatcttcccttcagttatgtataaataacttgaaattactagaaattaaaatcaaagaaaatctggaattactgaaaattttatttggagtttattaaagaatgaaattatacacacacaaatacacatatacacgtatactaataaaaactaattctttatatcatgccaacaaaaagtaattctattgtttctgttcctacaacacctagctttactatttaattttatgttaaattttgattattcacatttaaacacaatgagagtgctttttggtcattgaaagaacatgatagtatcataaataaatattgtaaaatattaaatattactactaataaagaaactaaataattaaaatactagtaaatatggtctcaatcattaaatgtaatgacaattttattttgatccttagcccagactgatcttttcatacaacgtcgttagaaggcactttgatttatattattgtttcagcaccatgctggtagtacctgctaggaaataagcaacttcccacatcagaacgggcaatgggaacaaccagaagccgcatggagatctggcacgggggccagcgagggcagaacgggagtcagcattgcgctcatggctctccgagagggtcttggcggtggagcacctgaggaaatgggagagttagccatgaggcctggtacaccagcatttcctccacctttcctatatgccaggggatttacaaaagatttttttttataggaacaaatagactatttatatccccaacaatcacctttttttttttttttagacagaatctcaaagtcagttttcagaaagtatgtgaggatttattgcgttccaggtaaaagcagctgcccattacatgaaatctttttttttttttttttttttttttttttttgagacagagtctcactccgttgcccaggctggagtgcagtggtgcgatctcagctcactgcaacctccacctcctggattcaagagattctcctgtctcagcctcccgagtagctgggattacaggagtgcaccaccacacccagctaatatttttgtatttttaatagagatggggtttcaccatgttcgtcaggctggtctcgaattccagatctcaaatgatccgcccacctcggcctcctgaagtgctgggattacaggtgtgagccacaccgtgcctggtgcaccaatcacctttgacacttcatattatagcagagaatgtctttcctcctgattattcaagaaaaaatatataaatgtatacattcatttctatacaattatgagctaaacaatactgaatatatcttactagatttaaataaaatttaagtaacaattttatttcatcatttctaatagtacgagttaaatagatactatgagtagaatttgttgtatggataaatggaagtaagcatggatatgtttgtatataataaaatacagtcagcatgaattttatccaatttttaaataaacatagagttataaattaaaattaaccagccataccaacccatttgaatctatagtttcctacaagggaatgaaatgcgaagtaatagcgagcctccaaatgttttagtcacgcagtgtagagcacccacaaatcatctcacccctctgtcggggggcgctgtggggtgccccggctttactagtagtgcttctctaaactcatgcctgcaccctttcttctggaagcctgaacaatgatgcagagatactgttttctttgttgtagaaaacagcagaaggtctgtgctcacgagggcaatattaggtcctcatcagctgtggcttgctatctccagcacatcaatgaatggagaaaataagatttaaacaaagatcagtgtctccattctctaacattttactcaaaatattggttaggttagactccacacccaccaaaacccaaaagatattccatctcacagatgctctacattctttcaatacagaaaccttacgacaaagcctacaatatacacttgttttagtaaaataattggtccagttagtaaaaaatgagttgaattagtgttctccctctcacacattataactataacttttttcaattacacaggtgtttacagaatttatctgaggtgctttctgtgtatctctgaaaacaccttcataacagtaggcacaccctggctagtggttctcagccctggctgctcactggtatcaccaggagagctctggacatactgaggcctgagcccttcccccagacactaatttaatgggactgtggtggggcctgggcatggatgtttttagaagcatctgctgatagataagcaataaatacgagtttattaactacacatggtgatttgatttccatggattcttccctgattttctgatccattggcccgtatatgaacaggctaacttctagtgtgtgaaaagactgacaggatattaacctggctaagtgtctttgaaaatataaatggagggaccatgccttaaaagagttatgaaaaaaaaaaaaacagaaaatatgcacctgagaggggcgcaaaggaagcaggcgaatgtggggtcttggagaagtcactcctgatcttgagtttctatgagtacacattaaaggaagtcattgcagttttctatgtactgtgcatttggatattttcacaaactgaaacaataattcgctgcttcgggaaggggaacagataatgtgttctaacgtagcatctttactttctctattattagaaacattttaaaaatctatctttctttggcttggcatggtggcttacagctgtaatccagcactttgggaggctgagactggcagattgcttgaggtcgggaatttgagaccagcctagccaatatagtgaaaccctgtctctagtaaaagtacgaaaaacattagctgggcgtggtggcgcatgcctgtagtcccagctgcttgggatactgaggcaggagaatcgcttgaaccccagaggcagaagttgcaatgagccaagatcatgccactgcactccagactgagagatagagcgagacccccatataaaaagaaaaagaaaaaaattatctttctttggagtctgtcaaatgtattaccactttattattagtgaaatttggtgagttatatcaaatgatcagtgataggagataatatctacaagatttaatgattgactatagggaaggagaagagaaaggaatagatttcttcttttttttttttttttttttgagacggagtctcggtctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccgagaaaggaatagatttctaagtcaaattccattgataatgatgagaatcatagggggaggagtcaatgggtaggagaaaaaatatttggtttaggacatgctgaatgtgaggagcctgtgataaaggataggataatatgaaaagcttccaaaaggagtacaccagattatgagatctaccttttccccaaacttataaagggaaaaaatatcaactccattgttaattctccattgatcctgatgaaacgtcagtactgctgatgagatgtaaaaataaaaagcagcaagactaaagttctccaagattcctctaggatatgtttggtgtctgcatttgcatttattgttatttaatctacgttattcaagatgctttctatttggaaccccaaaacaaatggttgaatgggcttgctctgactatctatttccacagaacaaccacccaaaatttagtggcttaaaaaaatgacagcatttattttgtttatgaatatgcaataactccgcatggtttggggatggctcaaagaccaggggcgaggatcatctgcaggctcatccactcacacatctagtggttgatactagctgttggatttccacgtggctcttcagcttcctctcagcctagtagatggatccaatggtgagtgtaccaggagagcagaagggagccaggcataggtgtctggcctttcctaactgagctgaggaagtcacatggtgtcatttctaccatattacagtcattagaagtgagccagtaaatctggctcatattcaaagagagggaaattagactctatttttaaataagtgtcaaagaatttaagggcatattttcaaactgccagagcgatcgcagaaggctctgccacctacaaccaactatttctttgcattttaatagaatttttaagagaaatcatagctgaagctgcggttatattttggagtcgtcacagtaaaagaaataaagtacatgtaatttgatatttcagagcattttttccctttgtccaagacattttaaatttgaaatatggttttggcagttttgtaagagatattatgtaaattgaaaggagaagatgagttttggagtcaatcttaaaaattcattttggagaagcacaacatttgcacagcatccgtctgatttgatgccgtttgtataaaagagccgtgctttcccaggagtggaaactacattattggaaaaatataggctccttagggtaaatgatagcacaaagatagtaaatgtcttttcatttgaaataacctttgtggaaatgctattattctcaatatattgtaaaagagatgaatcagaacggtgttagaaactatttaatggatcatctatctgtgacatattacaaagctaaatgttgaattagcacttggctaaaggaggcctcatggccagaaagggttcagctttggaatccacaactctggttttgaatcttttttttttttttttttttttgagacggagtctcactctgtcgcccaggctggagtgcagtggcgggatctcggctcactgcaagctccgcctcccgggttcacgccattctcctgcctcagcctcccaagtagctaggactacaggcgcccgccactacgcccggctattttttgtagttttagtagagacggggtttcaccgttttagccgggatggtctcgatctcctgacctcgtgatccgcccgcctcggcctcccaaagtgctgggattacaggcgtgagccaccgcgcccggcctggttttgagtcttggtttgacttttctttgccgagagatcttgaagttttgttatgaggattagagcacaattcctggtatctgctccctggctgacactcagaaactgagatttgtcattaagattgtgatggtgagatgatgatgagaaattgtttgactatctcaggaatagtagaaattattaaaatattgaattgtacccatgagactatgtggccaggcaagaagaatgagataggccctttcttcaaagtatatgatttttttattattgaagaaattattcataaacacttgaaaacaaagcatattcaaagttttaaactgtacctaaaagatagtgccataggagatgtgagattttgctaaatattttgaccttaaaatgggaaactcatgaaatatgaattattttaagggtctaatttattgcattttttgattcatatgaatttccctcgacaatgttaattcagttatcaggacaaatgaaaaagtaagctttgtaaattaaaatacagaaatatttacatattgtggcttgtctctggaacttttataatgggatattatattttaacataatgttgatgtaaaatattataaccaagatatcagcaatatagttacaagttgttcttttgaaacacagggtcataactcacaggtacctgatttcaaaatacatttggcataatttacaatttataaatctataatctctttaaggcgaattgttctaatgcataattaatgcactagtgccatgactaacttttaagaatgctgcattttccacaccagttcactgataacctaaaatattgcagtcattcttttaagaagttgttaaaaatgtctctgtaaaatataatggcaaatgctggctattttatgagtgggaattacaatagtaaatagtaaaacaaaatattttccaagaataaatgtgcttcatgtgggtttgatcagcacatctgattgaagatttgaggtgagatacattgtccccattaagtttaagggtttcagcgcaaaatcagctgatctactctttgaaacgcagggcatttgtgaaaatgccaaacgcatctctattagaatctcatccatgagcaaatgagtaatgtaagtcagatacaatggttaattctgtggtttgccaaatctgtacacttcctgttactttgtagattgtaaaataatgatgcagcattcaccctaatgatcaattgttttccttactaaaatgtaagcatttaaaagatctgcctaattttttctaagtgtatgttaggcagatctatacttcctactcctaaagcattcttctaaagcagtttattagagcgcacactaatggcttatcaattaagcaaacatgatcagtattgagcacttgctctgctccagggtgccggtgctaggttcacgtgcatcagggagacagagttatagtcctcatgaagcttacaggggggcagattgattgaaccgacacctctgattcccttttaagcctgtaagcagctgctctgtaaagcaggtgtttcaaacacaaccaccttcagagacgaggtgattctgttgagtgggtgaagcaggccaggcatgaggccgcaagcagtggtttagaccagttcattggagaatccctgccttattaaaaatatttccttccaaaaatgtgaaaggaagacttgtccttttccacaaatcatttagaaagcttgctttgtcacctctgcttctaaggagtcctggttggtctccaaaaggaagctttctctaaagaacagtgtagtacaaagtaagatgggacaagactcagggggcccactcctgagctgctcagccacttgcccacctcaggtaaacactgagcctggtggtctttcagtcattccaggtctgatgttctacagttttgtcaggttatctgggagaaattttgatgctgaagagtcccgaaagtaggagaagcatttcaaactgaggcctaagatgttttcaagttgtggcagagttgccttgaagaaggtaactcgggctttgccctttgcccttttgccctttgccctttgccctcacctgcagcctgcacatccatacctcacctctaatacagcaacccctgtttgacatgttgtatatattaagcttttacttaagatgtcatttaatgaaaaagattttgctgcttaaaaagcagtggagaataatagctagcctcttgagtacacagtcccgtaagatttgagcacatgatttttagaaaaagaatagaaaataagagaaaattataacctcactttacctgtcgggatattgacatcactgtcagatttcacaaagccacatgtgcatctggtgaaatcccagatccaccctttctaactgtatgctcttaggtagccaattaatctttctaggactcagtttttcattcattaaataggaaacttaacacatagggcttttgagagggttacatgagtcaatacaagcagagaacttagtacttcctctgtcacgtagtaagcactccttgttatccttggattttgtggtactttggaggagaatggcactcggatctctgttggtataatttttaccaaagtaaaatctggttgaaatagcattcagatttaggcttaaggagaggatatttcttagaaaggaaggctaagcttaatgggggaaaagagttatcagtgaggccttggggcaggggactgactccactgggcattacttgtgcaaaagggataaaatgtagagagagtttttttttctggtatattattttattccattaaagtcagtgttctacttttattttgtaaaatcatatttctgagtcctgaacaaaagactttcaagatagattttactgacagagaaatggagtgccacattccatagctttgcatatagagcttcacatgcaaagctctttgcatctcaagggctaaaactggctgacttacagcaagtagctttcctgtaaactgtaaagtagaagcgaacggagacagctatgaaggtgggaaaaatgcctcctgcagaagaagagcagacataggggagcataaatagtataccctgcctggaccctgagaaggacccagacctgcatgctgcatattgagacagacatggctgtggattctcattacttgggattctcagtgatgcctcaatccacaattttgtattaataaaaaagtctttaaaatatttgcatctaggaatcaaagtgtcattcaatgacttattggtcctcaaatgacagcttggggttgtactttatcttctatatcatggagtaactcctacactatattcattccaggagaattaactatgtcaattcttatgttcatctcttccttggctgattatttgttagggaaaaagcttttgcttgtttattaatttgtctccttcctactcttctgattattattttgtaatcaaaacaggattttaaaattcatagacactaaaatattctagacttttagcactggtttctaatattttgggaggagaagcttcattttttcttgaaaatgaaggtgtaaagatactaaattccttgagtggaacatctgggcttcatagaaactttggagctatatgatagttagagagaatgtagacagggttcctcattgtatagataagagaggctgagtgacttgtagaaggtcccccagtgagtagcagatcctggatgcatgcagcattgctaactctgagagctaagtcctcatcatgtccccaccttcaccacaccacacagttcaggagaaggggcacatctctagaatatggctggaaaatacactagggaaaactttagatccactagcagagtccagtgctcctcttggagaaagtgaccagaaagaataaagcacagttagctgttgaagaaaagctgatttctcagccagattatgtacattagcatccatgttagttacctttgctgaataattctctcctcaactgagctctctgaagaaacctccaggaattagcagggctttgagtagagatggcatatgtttgggccctgatgaaaatgataaaattgtggcctggttgcagcttgtgtgctgaaggaagagcatgatgcagttcattggtatgaaaaatgaatgcaactaaaacctaaacattaaaacttggcctttattaccaaagtgaaagtgcttctaattgaggctccctgggttttaattgttcttcaggaaaattagatgttgtcaaagtagaaggttaatgtctgttcacagtctggagtttttggaataacttccttcacagcgtgtgtgttttaaacataaaaagggctttttggtttgtatatagttagtgggattacaactgcctcactagatgcttacaacaaatatttaagaaatccataaggtctactatttataacagaataaacatttaaatttaagatattttgaccattttggtaaaacatttaaaaaataaactatcatgaactgacaaaaccaacatcatttaaaaaaattcaacatggcaaaaactttatgagacttataccatagaccaaatttgtaactttagccttgatacattactgcttgtaaatagaaatgttcttactacaaagtgatgtgctcagatacacccaaaatttattaaaggcatgtcaacagccaaattctgtggtacaaggtttttcatacattattttacataacctttgaggaattccaattttatattcccattttcagaagagttggttagttactgaattcaacaaatgagtgtgagcaggggcctggagtacttaaaaagaataaacaaaatgcctttaaatcagaaacacaaaattgctagtaatttcagttaattgcactttactccatgtagctacaattgtagatatctagaaaaaatatctatgataaaagcctgccatctggaaaagtcaaaagaatgatgagctggtattaaatctcagtaaccctgacatatggaatatctctgccatgttaaaagcagaccttggtatgagactgactctgggctttacatatgaatttggaattgccaatatctctacttgaactatgtgagacaataaaagtgctcccttatacactttagataatgggccctttgggggatctgatgttcattcagcctttcccagaaaaatacaactataataaaatgttgtaatcagtttcagtttatttattgctgatcttttatttttgttttaatttaacatggcaatccactttctatagtcaaaagtgcaatttaaagaactctaacaacttcacaatctagaagaatgtctttggaaattttaggattcaaatctaaaacaaattttgagatttctttttcctagattgtactgatgttataagtgccttatgtaatacccagttcttccccatggagatttctcagtgaaagaaccacatcacatgttcacaagagcatcaagaataagagggtcaggtacctaggaagaaagattggctagcattctctctcccccatcaaatataaatggatttagcacagggattttgtttaattcactactgtcagcacctagaaaaatgcttgaaatttttaatatgacaatgcacaattcaagaggaaataataacattgtattagtctgttctcacactgctataaagacatgcctatgaagtggtaatatatgaagaaaagaggtttcattgagtcacagttccacaggctgtacaggaggcattgctggggaggcctcaggaaacttaaaatcatggccaaatgcaaaggggaaacaggcacatcttcacatgactggtaggaaagagagagcggggaggtgctatacacttttacaaccatcaggtctcttgagaactcactataatgagaatagcaatagcaagagggaagtctgctcccatgattcaatcacctcctccaacattgtggattacaattcgatatgagacttgggtggagacacagagccaaaccatatcaaacattagtatgtgaaagtagttattatgataaaacatattttaaccaacatacaattagttatacgatttttataatgttttcagtgttaaaatttttgaaaaaactgcagaaaaacaagtggaaatgaacaaaattacattgacagtagtaagttgtaatgtttaattctttgaatgtttcagtgggagctagaaattggtttgatatactttttagttcagttggaatacttaacacttctccactttgcctaatatatgctgcagcaataaattaattttccttctgagatttctagtaatttggggagtgcttatttgcaaagaattgaaaaaaaaagtgacacaaattgatatatcacgcaaactatgtggttttgtattttcaactaattgctgaagagcacttatacacaaaaaatatcagattcctcaaagaggagatatttaaggcaagcaaagaaatgtataggtcagtttccttcaaataattttatttcttactcttaaaaatcttttatttcagattcaggggctacatgtgcgggtttgttacatgggtgtattgcatggtgctaaggtttgggcttctattgattcccttacccaatactaaacatagtacctaattggtagtattcaaaccctgctgccttttctcccaccctatttttggagtccccggtgtctactgttcctatctatattttccagtgtttagctcccacttataagtgagaatatgcagcgtttgtttttctgtatctgccttaatttgcttaggaagtggtctccagctgcattcatgttgctgcaaaggacatgattttgttctttttacggctgtgcagtattccacagtatatatgtaccacattttctttatccagtccatcgttgatgggcacctaggttgattccatgtctttgccattgtgaatagtattttgataaacatatgagtgcaggtgtctttttggaagaataatttatttttctttgggtaactacctagtaatgggattgctgggtcaaatagtagttttatttttggttctctgagaaatcatcaaactgctttccacaggagccaaattaatttacattctctccaacagtttataagtattccctttctctacagccatgccaatatctgttgttttttgactttttaataatagccattctgactggtgttccttttgcccactttttaatgaggttatttgggttttctgttgatttgtttaagttctttataaattctggatatttgttttttgttgggtacacagtttacaaatatcaaatattttcaatgtagaaacttggatctttgatttttatgatgataaattgaggcatattgcaagaaaaacatttgaatcagaatatttaccaatattatcataatagtgaattacatttttacttgtccctacattttggtaataacaattaaattttgctaaataataattaagtgctggtccaagatggtggactgattattcttccaggggaccaatttcaatgacaataaatgagaaaatgatgtgaatcagtaacaatactaatttaagctaatttctatatttctatggtgtacatgttctttgaaacaacaagtatctatcgctgtaagaataagacatttggaaaatgtcttatatatgtgagatatgtcatatatatgtatgtaaataaaccataacctttctatggtatatgatgtgagctattttcaaatatgtgagttccaacttccctctgttaaggaacatttaactttgagtgattcatgtgacttctgagaccagctgtccccagcctctgagattcagataaaaacaagtatccttagctctagattaatccagtggcactgagcatctatggtgatgaaggatatgttttcggtagtcattttaccaaagatggtgctgtgaaaaccatcaaaatataaatcatggccttaaccatctatctgagaagacaagactaatacacttgaaacacaagaaacaaatgcaagataatatacatatatttgtcattgaattttgtaatacagcctacaaatgttatagaggctcatctaaatgaggaagtcaatgatgcatagtataatcaagatatgcttcctagaacacattgtgtagatggatttgaataggcagatggataaagatgaacatttaagacatgagcaaatgcctacacacctgaaaaaatgtggcaagtctgtataggagagaagaacatatctgagggcttgagctacggtgtgataaggagctcatttgaataatctggtggaatcagatgggctatggaagcctgatggagtaacacaagcagataatcaacaaagatgcttatcagctctaagaaggaatagaaaaaaatttcagaatataaaccatggaacatgtctcaaggaaataatttttatatgtataaaatttaacctaaatataattctataatgtaaacagaaaaaaataatggactggaaactattttcatcaaatatgaacattataaattactatcatgtgttactcaatgtactttaaattttagacattttaaaatgattcaatttttcaatttgtctttaaatttatatataatatatttgagatataaaaaaaccaaactgtttttcttagtctcacacactcaccactcaatacattacttcacctctggtcaccaaaatatgtatggatttttccccgcatgcaaagtaattctccagcagacaccactagggtggcctattattgaattcaattctgacactatctacttggatatagggtcagatcccacacagtaagggcacagtctcacaagacttcccttcacttcagatgccaactgcaggtcccaggatgtgacctgtacttctggccaactggctataaattggaggttcccattaccccctgtttaggttcaattaatctgctagaatggctcacagaactcagagaaaaacattatttacatttactcatttattacaaaggatattattaaggaaactaatgaacagttaggtggagaagctgcatagggcaagcttgtccaacctgccttattttgttgagattgttgttgttgtttttgttgctgtcctgttttgttttgctttagacttttagcaacctgaagccatggtttttagtttctgtctatagtgataagcagaaaagaggaagaaggaaggggctttactggcccaaccgggaacagaaactaagaactcatgactgtattccctcccttggacatcactgaaggtgtgagagaaggggtagggagcttccgtgccctctctggtatgccaccctcaggcacctccatgagttcagcaattcagaagctctccaaactgattttggggttttatgaaagcttcattatgtagaaatggttgattacatcattggccattggtaatcaactaaattttcagcccctttcctcttcctggggaataaggggttggggctaaaagttcttatcctctaattacatggttggttttcatagcaatcagctcctattctaaggctatccaggagcctaccaagagtcaactcattagagcaagagatgctcctataatccaggatattccagggatgtaggagctctgtatcagatactcctatcactcaggaaattaaaaagttcttcggagctctgtgtcaagaaccagggtcaaagaccaaatataagaacaaaagatactcctagcatccctatctggcaagggttttagaagctctgtctcaggaatcagggacagagaccaaatacataatttttattatatcacaatatcacatggcataattcacttttatattttgtatatagttcaataagttttaccaaatgcatgaagtaatgtagctaccactacaatcagtaacacagaatagtctcatcaccacaaaacaactctccctggaatcccctttgtaagcactctctactgatatgtaacctctagaaaccactgatctgttttctgctcctataatctggtgtacttcagagtctcagaaaaatgtgataataggaaatgaatgataaaaagctataaaacctacagaaaacaaatagcagagtgccaatagtaagttcttccctttaaatgtaaatagattaaactctgcagccaaaagatatagattggcagaatggatttttttaaaaaaatccacacaggatccaactctattctgtctataataaactcactttagccctaagtacaagcacaggttgatagtggaaatacggcaaaatatattctatgcaaatagtaataaaaagaaagaagggtgcctatactatcagccaaaatagactttaagtgaaaaactcttataagagacaaggaagggcattatatagtgataatagaatcagttcaccaagaagacataacagttttaaacatatatggaccaaacaccagagcttcaaaatatatgaaatattttcctaaatcagagtcatgggtattttctcctagattatcttgtaaagttttataattttacatttatgtctataatccatttttaattttttataaagagggagttataagtagaggtttatttttcacataagatgccaaattattccagcaccatttattaaaaagaaaattctatctgttctttgatctttatcaaagatcaattgaccatatatgtgggcatcagtttatggattctctattctgttacattgacctgcatgactatcttgattactgtaacttaacatcagatagtgtgattcctctaactttgtcattttcaaaattattttagaatttttgcccctttaccatgccctatacaatttaagaatcagtttgtgctttatcaggataagaaaattgcctttatttgtactttgctgagagttttcataatatgtggatattcaattttgtcaaatatttttatgtacctagttgtgtgactgttagattttatcaaagcattgtaagaaaattgctatgagtactgcagaggattagctcttcttgttattcccagatcagccctatattttgactggaatttttcatttcactaatatgtatctagaggactgtatattcttccctatttatttaagcaattatttatatacatttagaattaaaaataatttaatactttgagatataattcaatactactttgcttattttattgcacaaattgttctagttttggccactgggagttctttctgttggctcctgtattcctttgatatacccccatcattgagggtttttaaaatgtggtttattattaatgaaattaaaatgatctattcatagcacctgagatgatttcagatatcatattatgcaagcattaagataatattaagaattagtctggtaaatgaaaatcatagaatcagagtacttactcaatgtcaagttttgctaataattgcaatgacacaagcagttatatgacacaagtgaagcagaaagtgttctgggaccccaatgtgacttattgggtcatttcttctcacatgagatgtgttctggtacagatcttgcacagaagaagccacttaggtcatgaattactgagttacatagtttatgtgacattttccttggagccatcccctgtaaacctaaagattccaggtctgtttaccacaggtgattctagataggcagctatattttactatatgtatttcatagttctctcttgctagccaaggtcacatactttgtttgccaggagagctgccattataatgtttacaaggcaattagacaagataatatgctttctttcttcctttgatgcatcacccaaactctgccatgagagagaagggcatgcaggtctacttcataagtcctttctttctagatattctggtacagtattttaatgtattttatgatacagatactctagcatttaatatattttaatgtatcatgtttaatataagctcgataaagaatcatcacttcacatactttggataataattgtacacagtgcaaattcatggagaaaataatcagaaccattaatgctgataattttggggcatttaaacctttttcaggtcaatggattaatagatttattagctcttgcagaatgcaagcatattacagatttatagtataagtggttaaaaacatttttatttcactgaaaattcatgtaaagtgaagcctttgcaaaactgtaacctttatgcttttaataaaacagtatttctgttgtacatggtaatgattttgttctggaacactatgtataagcagattttgaattgaaggcagtggagcaagtctgtcaaaaatcaattcaattgatttccatttatgtagatgcattgagttttacagtggttgaagctctctttaaattgattggattcagaatgcaggccagtggtccgcatccatattctacaccttttttccaaaacttggtaaagaaaaatgctttagaaactttcctgaacaaataatataaagatcataccatctatatgttaaccaattagttatgaaatctaaaatcattaaggttacatttcaaaagtgaagttactaaaaaggtgaaattcaaatctaatagaaatagggtaaaatgcagaacatttatgaaacataaaagagggactatctgtgttagcaattaagggctgtagcaatttctgatatcagattccaaatttgaagagatccagacacttcatatacaggtttattttgccctaatattttgtcttattgagaattgtggtaaagagagaagacctgagtttcattcttataatggtttgagacatgaggaagtcactgaacatttctggacgtaactcacttgcatgatttcaactatcacatatacttggatgcttgaattacaaacctatgtagactagactttcctgctaagctgaaaagctgtatatgaacatttctttcatgttagctccagttgactgtttctcaggtactttcaatttcacatgtcccaaatttttctgattttcctctggcctctgaatgccctttctctgtgagcagcatcgtcacacaccttgtcacccaatctcaaaaatggaaagacaccttccaaatagcctcttctcaccacccttatcttattccacaccctgtttcaaacactgtgaaggtttttggggtagctgttcaaaggacctaccacaattagtttctgaaaagaacaaaaaaattactagctccagctggttgaccatcacaattgagatcatgcttgattctgcctctgatgtaagattttcattgctcaaggcagtcaataaattttgattcttaaagacacactctgataattttctgtgaagtaggaaactcactcaagaagaccagcctttgagtggtatcacagtctagactttaaatttataaggtggaaatgggctatagttggaatagattcttagctctgtggattctatttctatcacagctctcctatccacctccctctccattgcccatgaaatggcctaaatccaggcctttaacactttttatttgaattattatggaaatagttaactgtccttactgcctccagacatgcttccctctagcttcctccttcatattgatgtgcaatgatataaactccaaatctgatccaaatctgctgaaaagcctttaataaatgacttcctacattttttcaggaaaaagtttaagttttgtggctcatcacataccacattttttgaatgaatatacagtaaaataaaaagtagtagaaataccatttgacccagcaatcccattactgggtatatacccaaaggattataaatcatgctgctataaagacacacacacacacacacacgtatgtttattgcggcactattcacaatagcaaagacttggaaccaacccaatgtccaacaatgatagactggattaagaaaatgtggcacatatacaccatggaatactatgcagccataaaaaatgatgagttcatgtcctttgtagggacatggatgaagctggaaaccattgttctcagcaaactgttgcaaggacaaaaaaacaaacaccccatgttcttactcataggtgggaactgaacaatgaaaacacatggacacaggaaggggaccatcacacaccggggactgttgtggggttggggaatgggggagggatagcattaggagatatacctaatgctaaatgatgagttactgggtgcagcacaccaacatggcacatgtatacatatgtaacaaacctgcacgttgtgcacatgtaccctaaaacttaaagtataataataataaaagaaaaaaaagtagttgaatgaatatagagtaaacaaaaatgggtgggcctcatgcttctataaaatacaaggctttattaggtaaattaaaagtttcttaagcttccaacattttcttattccacaggaagctgtaaaattttctgcactggatccacactttgtctttatattctcctctcagcacaccatttcccaatatttggcaacccacaggttagcatcgaaaataaacaagtcagggtggctggcaaggtggccaaataggaacagctctggtctgcagctcccagtgagatcaacgcagaaggcagaaggtgggtgatttctgcatttccaactgaggtaaccagctcatctcattgggactggttagacagtgggtgcagcccaaggaaggtgagctgaagtagggtggggcatcacctcactcacgaagtgcaaggggttggggaactccctcccctagccaagggaagccatgagggactgtgccatgaggaatggtgcattacagcccacgtactatgcttttcccatggtcttcacaacctgcagaccaggagattctctcgggtgcctgcaccaccagggccctgggtttcaagcacaaaactgggtggccatttggacagacactgagctagctgcaggagttttttcataccccattggtgcctgagaatgccagcaaaacagaaccgttcactcccctggaaagggggctgaaaccagggagccaagtattctagctcagagtatcccaccccaacagagcccagcaagctaagatccactggcttgaaattttcactgccagcacagcagtctgaagttgatctgggatgcttgagcttggtggggggaaggctactcaagccatcactgaggtttgagtaggcggttttcccctcacagtgtaaacaaagctgccaggaagtttgaactgggtggagcccactgcagctcagcaaagccactgtagctagactgcctctctagattcctcttctctgggaagggcatctctgaaagaaaggcagcagccctagtcaggggcttatagataaaactcccatctccctgggacagagcacctgggggaaggggcagctgcaggcacagcttcagcagacttaaacgttcctatctgctggctctgaagagagcaatggatctcccagcacagcgctcaagctctgctaagggacacactgccttctcaagtgagtccctgacccctgcacatcctgactgggagacacctcccagcaggggtcgacagacacctcacacaggagagctctggttggcatctggtgggtgcccctctgggacaaagcttccagaggaaggaacaggcagcaatctttgctgtccggcagcctccgctggtgatacctgggcaaacagggtctggagtggacctccagcaaattccagcagattggatgttattggtttatagaaatgctactgaattttggacattgatattctatcctggaactttgttgaagttgtttatcagagctgggacccttttgtcagagactgggattttctaggtatagaatcatattatctgcaaacagagatagtttgacttcctcttttcctgtttggacaccttttatttccttctcttacctgattgctcttgctaggacttccagtactacaatggctaggagtgatgagagtgggtatccttgttttgttccagttctcaaggggaatgtttctggattttgcccattcagtatgatgctggctgtgagttgtcacggatggctcttattattttgagttatgtaccttcaatacttagtttgttgagggtttttaaacacgaaaagatgttgaatgttattgaaagacttttctatgatgatcatgtggtttttgtttttagttctgcttatgcaatgaatcaaatttatggatttatgtatgttgaaccaaccttatatcctaggaataacgcctacttgatttggtagattagcttttcgatgtgctgctggatttttgttgaggatttttgcatctatgtttatcagggatattggcctgaagttttctttttccattgtttctctggcaggttttggtatcagaataatgctggcctcatagaatgagtgagggctcagctcaggctctttgttcactccccagcttgcaggcagcaggggcagggaccttggcagtgacaatgttagagggcgttacacttacctcttggagctccaacccagagaaatgcagagcctctgctaaccaaaatgatcagcccggggtggagtggctacatcacacacccaagttgtaggccttgcctggtggtgagcagggggtgggggctcacagggaagacagtctggcctctttgggaaagagcaaagaacctgagtgcctgtggtgtgctggaggtgtaataaggcactcaagttctttgttctttcccaacctggtggcagcaatagcaggcaccgctgtagcagtggtgtcagagggatcgtcagttgcctctgagaactccaccccagagatacatgaagctactgccaatgggaatgatcagctgggggtggggtggctgcatggcaggcccaatccaggggccctgcctggtgtagagcagggggtcaggggttcacagggaaaagagactgggttcctctctgtatggcagctgcagcatgctggaggtaccagcaaaacagtcaggatctttgttctttccccagcccgagggcagcaagtgcaatatccctgcagctgagatggtagacagcctttgggtcgtctctgggatttcctctccagataaacgcagtgccaccactgactgaagtgctcaggcgggggcaggatgactgtgctggggtccaggttgggaggccctgcacaatgaggagtagcaggggcaggaatccacatgggaaatagtctggctgcttttctgtatggcagctgcactgcgttggagacatacgatagtccttaggctcatcacttactccctctgccgcctcagggcagtaggggtgggggctgcagcagcagcaaaaaggcagaactgtcagttaactctgggagctctggcccagggaagtgcagagtcgctactagcctaagtattcaggcaggggtgtgttggctgcgctggggacctgggccggtgggctttggctggcaaggtgtggcgaaggtaaggcctatagtctgtctgctcctcagcactgtgaaagcagcatgtatcttgggagcatgcaagagggcttggcctcacctgctggcagagctatggcagctgaccctgggatgctcaggagcccaaggcccttgaggctccatatgtgcctgagtggcagctctgcccagactccgcacagcgctctgtcagtctggaggccctggagagagagggtcaggggatctcctgtgcccaggattgcagagatgcatggcaagagtatgggctcctgggggctcttgctcactcaccctttccctgtggtgagaagccttccttggctccatgccaatcccaggtgggcagctgtcctgtctcactcttctctcttctctcggggttttgttgcttccttgatgagtcccaacgtgtcctcctgggcaatccagttgaagaggtagtgtttattggccattctgtccctttatattatgcaacccatctgagccatagtccttcagccacatccatgaccaagtgcctgggagatttaaataaactcggtgctccgcttgtgtagtaaaaacagactaccacctaagctgagatttttaatcatcacttatggaaaggatatccatgaaagtccattaaaactatgaatatatacagattgaatatctgataagacacatcttgaaaatacgtaaatattttgatgcataatgtttaaggaaggagaaaagaacagagacctttttttaaccttttcgtcctatgtgatatctgtatttagaatacagttaactcatctgcaaatccgattctaaataacagagaaaaaaatctatgttaatttttccccatttcacttgtattatttggggatatgtaatttctaaaaggcaataggcaatacaatgatattttaatttttaaaaacaagcagttttttttttttttttttttttttttgcttttctcacttggaatgccaatcaacaagggttttttggttttttggttttttgcttgtttgtttactccacttataatgaaatcaagtagtttttctgaacagaataatatattcaggggaagaaatagcttataagattattgactgaatgtgaagctcaaacattaaatgagatgaaaaaactaaattagttattccctgagacaaacagggatgggagaatacctctgggaggcagctccttttcctcagttttacttatgtatttagttcaacatatccacacatagtgcttatcatataccaggtactattgtaaaatacgtaactgttgatttactggattctcataactccctgggaaggttattattatcattttgcccttttacctgaggcaagtgaggctcatacacggtgtgatggttgattttatgcatttacttgactgggcatggggtgcacagacatttgatcaaacattcttctgggtacttccatgagggtgttttctgatgagattaacattgcaatcagtagactagttaaagaaagcagattgtccttcttaatgtgagtggccctcatctaatcaccagaaagtctgttaagtagaacaaaaaggctgattcttgagcaaataagaaagaactgctcctgcctggcggtttcagcttggacattggtgtcttctgtcttcagactcagctgaaacattggctcctcagactcacactggaactacaccattggctctcccaagtctctagcttgtcagttgcacatcttgggacttctcagcctccataattacatgagccaattccttatcataaattttattatatatatgcatgtgtacacacacacacacatgcacacatatgcacacacgcacgcacacgtgcatgcacacacacacacgcactcacacatacacacacaatctgtttatccagaggactctaatacagggagtaagtgtctcaaggccacatagttacaaagctcacccagggagtctgactccagggcccatgctctgggcatcaaatatcactcaatgttcacataaaacataatgtcttaggcacattacatgtacagtaagtcataacttaatgtcattgataggttatttgaaattgcaactttaagtgaaaagacatactgtatgccataggaacttaactcttatatcaattagcatatggtaaaattggttttgttatatagtacaatattttacttaaagttgcagtttcttttttttttttttttttttgagacagagtctccctctgttgccccggctggagtgcagtggcgcgatctgggctcactgcaagctccgcctcctgggttcacaccattctcctgcctccgcctcctaagtagctgggaccacaggagcccgccaccacgcccagctaatttattttttttgttgtatttttttttttagtagagactgggtttcaccatgttagacagaatggtcttaatctcctgacctcgtgatccacccgccttggcctctcaaagtgctaggattacaggcatgagccaccatgcccagcctaaagttgcagtttctaagaacctgtcaatgccattaagtgaagacttactgtactcctgtgagatcaatactaatatctcaatttgagaaatgaaaaatttgagtctcagatgatttaagcaaaatacccaaggttacatagttctatgtagctgaggtagaacttgaacccagatctttgtggctccaaacaccattttctttccaatttgccttctgtcagttatctacctttaattaatataagtatttatctacctttaattaattactatacataatcatgaaataagctgaattatctctgcattttaagatctagataaaatgggtttattaccacactggtggaaaatcccagtagccctcctgcatttatgtgaatttcagattccctgactctgaattgacaagttctctaaactcttttttctctttgcagcatctagaaacttcttacttccacatgaggaatgcaatgtcatttgttggattttcacatgacaacaaaagaaaataataaacaagaccttgcttgcatggaaaattcattgcctattgtaggaaaagtcagggatgtcattacacagagcaaagaaaataacagaggttaatcaatgttactgctagcttgctcttatatatacttattttcatttctgatgcttttttcctctcaagggtaaaaaaacaaacatcaaacctctataaatctctcatgcagggcacccagctttctgcagctctgtccttctttggtttgtaatccacacttttgaagcccttctaagtgcattcatagacaaggccatctctccccttggcctctgactgtggggcagggggtaaaaagtgggaggtgggttatatgcttctagttgggtaaatgctaagcgtttttatgtgggttgcattttatttttgctttctaacaaacataattgaacattcagaaagggtaagtaactttccaaaagtttcacagatactgaaagataagtcagggttcatactttggtctgtctgatcacaagccagactaagatttgaacttctatgagactgtttcctcaaatttaaaatcagaatcatgttatctaattcactggctgaaccaagctcattcctcacccattttttattggtacttcttaaagaatgtggtcctcactctctagattccatgttttgagcgtaaaattcctatccctgtaccccaggcagagaggactggaccaggcgtggacctctgacctacaagatccaaggcattatgtttgccttgttcatcacctccttcaattgtagatgctgcagatgctgccctctctgtagaggtttaagtaaacaggaaagaatgtttaatgaaaataaggggaacaaagaaaccatgtggagtaaaagcagagatgacacatcaggaggccacaaatgaacaataagtgaaacattagttcctggacctcaaaccttcatgccagcattcaggaggcttcctaggcaaggaagtaaattggtgtgaggtgactgaactgcaagatgaggtggaatttcaacattcagactgccctctctgcagaggtttaagtaaacaggaaagaatgcttaatgaaaataaggggaacaaagaaactatgtggagtaaaagcagagatgacacatcaggaggccacaaatgaacaataagtgaaacattagttcctggacctcaaaccttcatgccagcattcaggaggcttcctaggcaaggcctgtcagctgtcctatttcttccactagatctctttcttttgttttgtttaagctagtttcaatgacaggcaactatctcttgtaatgaaatgatcctaagataaagggttattgtaaagttcaaatgtaattagataaggaaatgtgcgtacatgtggttagcacatatctagaaaatgatggttattaaagagtaactgtttggttacaattatctcaatcttagcactattaaaatttcccggaggtcagcctgcttttttcaggacaaggattataatattccacgagattcaaattagtcatatatttttaatttgaaaagaaaactacaaaagatgttataattcaatgtaagcacactttatagcaaatttattgtttgatttcattttcatgctatattaaaattttttgtatcagtgcttgtccaacatggtacaatggaaacaatcacattggaataatcaaatttttgaattacttataatatgctctttcattttaccagattttttgaaacaaaaaatgaatattgaagaatattcatagtatctatagctattttctgttcagtttctgaaagaatgaggaatagtagcttttcaaaagttggattttggtttttgtttaattataatatcattcaaaggactaataaagactaaaaggaacaatgactttattgtaaagatacatatagactgactcttcaaagtcaccatgaggaaggctgcactgtggctatttaaatgtaaatatatttaaatcaaacaaaactaaaaatatagttttttagttacatgagccacatttcaagcgctcaatatgttgctaccatattgcataggtatggaagatttccttcaccgcaggaagttctgtaaagcactagctttctccacatctttctttctttattaggcattgttttccataaaattttctacctgctatgaccactcaaagctctacttccatctcacccatgggcaaaatatgcgctacagtggccatttacctttttgttaaagtcacagaaagaatgtagtaacactcttattttttttaatccaacaacctcttttaattgtgaaactgctgcctctgactacaagcatgagcaattgaccaggtctaatctcatcaaccatggctccttatattccttactctagttgtgagtccaagggtaggcatggaatcgtattaggatcatagatcctctatgagattataatattccaatattggggcaagataggtctctcttgcttttacttggaacaagtgatcgatggagatggcagaggccatcttggcaccatagggaaaaggcctgcttgagaatgaagctaagcaaatgcaaacagtgctgagagatgtggcattgttcctaaatctcaacgtgtgaaaaaaccaattcctttagcttgaatgtggttacagctgtttgcaaacaaaatatttctgaggctgaggagggaggattgcttgagcccaggagtttgagatcagtctgggcaatgtagcaagaccctgtttccatgaaaaaaaaattacctgggcctggttgtgtgtgcctgtagtcccagctacttgggaggctggggtaggaggatctctcaagcccaggaagtcaaggctgcagtgagccatgatgacactgctgcactccagcctacgcaacagagtgagaccatttcaaaaaaaagtctggttaatatatgggtatttgtgcattttatggcattgtgtattaaaagatacatatttacaatactacattatttaactctctaagtagatttctatatagtataatactgccattatgttttgtctttgacattgcatattgtcaattttattcagtttatttagtgcatactttatgtaaggtactctcatattcgacaaaaattcttctaataaaataaatggacaaatcaagaatgtatcaaagaatatgagttctgtcttgatcattggtacagtttggatatttgtgccctccaaatctcatgttgaaatgtgatccccagtgttggaagtggggcctggtgggaggtgtttgcgtcataggggtgggttcctcatgaaaagcctggtgtcctccctgtggtaatgagtgggctcaggttctattagtttacaggaggtctgattggtaaaaagagtctggcacttcgttccctctctcgccatgtgagaggccaactcccccttcaccatctgccatgattgtaagcttcctgaggcctcaccagaagcagatgctgatgccatgctttttgtacagtctgcagaactgtgagccaaaataaatctcttttccctataaaccactcagcctcagccaaccgcggtggctcacgcctgtaatcccagcacttcaggaggccaagatgggtggatcacgaggtcaggagatcgagaccatcctggctaacatggtgaaaccccgtctctactaaaaatacaaaaaaaaattagcctatcgtggtggcgggcgcctgtactcccagctactcgggaggctgaggcaggagaatggcgtgaacccgggaggcggagcttgaagtgagccgagatcgcgccactgcactccagcctgggcgacagagcgagactccgtctcaaaaaaaaaaaaaaaaaaaatcactcagcctcaggtattcctttatagcaacgcaaaatttactaatacaatcacaattactttttaaatgcaaactagctgggaaagttgtctgtctcaaatatttaagactataattttatgatcatacaactcatactcccagcactcagtaaagacaacttatatttctgtcagtctttcatatgcacaattagaaaatgattaaaatagtctgataatagatttccctgttaagttcagaagcccagtattctttcttggtttttaactggcatgctacttttaattttatatttatttctgttaatgatgaatatagaggcaataaatactacttttctttatataggattggattacaattaactgatgaatttaggaaaggacttaaagatttatttttatcatcttgtaatttaaaacaaaacaacagggctataaactccaactatgcaagtaaatgtaaagctcaacttcaaaaaataaatgacttgacaatgatgaaaaagtagaaaatgtttgagaaactttatagaaatatccttttacttcaaaaacaggagaaatgtgtactacaggtaggcccctacttacagactcctaattattcatatgtgaattctcagaaggcaagggctgggggtaatactgcttttaatgaaaatctgcttttatgagttttcagatgccataaccaaactgacattgtgtaccgttgttctctggggagcttcatgcgcagaatgaactcatatgttacatgaccttgggtcaaacaatatcttaaagaagtaatcagtataacatttcagaaattgaggtggccaaagtcggtccaggaaagtctctcaggatttgatatgctgagtgcaggagaattcattttccattcagagaaaaggtcgtacaaagtattcatgtgcctcaagtgctgaaagcaatatagaagaagaaaaattgggcttaaacaaaattttaaaaaatctgtcttcattttctcccccatgatcctttatatctaggaaggctattactgtggagaggccttaatatggactatttagaccagtcatttgaataaacgtcctaacaacagcagaaaaacatgatcagtgttctgcagaatctggacttgtaatcaagtagtcagtgtttaagagacaagtttaggtcatggaaatatactggagccaaaaatcagaattctagtttttgctccagcactgatttgttcagctatgagtgacgttttcagatagatttctttagggtaggaagcaataatgttatatgacttggaaaggcttgatgaatgttactgagtaaatagatgtttgctgattgctgttgaacagtggatcaaattattaaagaaaagttaggatagaaaaatccaaatacaggcggggtgcggtggctcacgcctataatctcagcactttgggaggccgaggcgggcggatcacgaggtcaggagatctagaccatcctggctaacacggtgaaaccccgtctctactaaaaatacaaaaaattagccgggcgtggtggcaggcacctgtagtcccagctactcgggaggctgaggcaggagaatggcgtgaacccaggaggcggagcttgcagtgagctgagattgcgccactgcactccagcctgggagactgagcaagactcggtttccaaaaaaaaaaaaaaaaaagaaagaaagaaaagaaaaatctaaatacaaaattataacagtatgtagccatttagagtccattagttacaaagctgttaagattatagatactgcatattataatatatacgtgtggaatttctggaactgatattgtttttgtttaggcagttgccagtttggcaacattttacattttctgtagtgagtgaaaacaaattatttgatctgtaattactattttatgaaacatattatttgactgttaaatcatcaattcttttggagctggccaacaatgtaccaatttatttttagtagtgcagcccatgataaagaaaagcagaaagccactaaggacaaaaagattactgagagctcctcctcattgtacttaaattttgtttaggatgagataaatggaaaaagagcttcagactttgaagatctagaaatttgggcaaattttccaaatgttcgtgtggatgagtaaactgtcacatttccagaacgaagaacattgttttttattctgcatggagtagtattagggaaaatgttcaattgaaaaagttaccatataagaattatatccagagtatcatatttaattgattttttgcttacgcaaaaaaaaaaattcaattatcaatgtttttgagcaaaaataaggcaacaggtcaggctctaaaaataaatataagactataaaagatgcatgtcttatattctaccatggtaaatggggcagtggtaaaggagaatgcagagtcctccttctggtatacagaatttatattattgctttattattgcctcacacacatcaacccttgaggcagaaaagatgtgttcatagaaagcaacttaccagtgaccgtgccagacatgttcaaatatgcttcactatttgaagcatggtaagaatacactaatattaatgtaacatcgacaggaattcagtaaagatagaaatctgacaatagtaacaaccatcattaattaatgagtccttgttatataccaggcactgtgttagtgctctctgtctttctgtctgtctctctctctcagaaactatgcatattcatatatatttatataaaatgatcatacaattccagcagccacataaaagtttggaagcgtttccccttttttctctttttgaagaaatggggaaacacaggcacagacaaatatggaaactttgcagcattcatgcagaggatgcagaatggagcctgaattaaaatgctccctcagatagaagaggctttctttctagaaagactgtgtggtgaaggtcctggattgtgacaaatatgctatttcctctaaacccagactccctcctcttcaggtggtttgaaccatctttcctacccctaaacctgtagattatgcctccatctctcccatccttacactccactcaaaaggtaagctgctctcttcgttctttctcttagtccattctgcctccaaatgtctccaccatactctctctggaacaccattccattctcatcaactccctccacatcctctaccttacacaccttgacttaagtgagccttctataaagacactgcccacctcccacctccagcaattgcaaagggatgcttctcagagttggaggcttcttggggttgggaggagaggccagtgttctccaccctcagtgcagttccagaccattcctcctatgaaacaaaccctttcccttgaggctgacaacatccagccatgtgaccctgtacttctttctcacactcttttgcttttactgaagactttgaagctttttctctaagtttcaccatcatttttgtatctggcacatagtagttgctaaattatattattaaaaaattcacagtgattattcttaataaattatgtgtgatacactcacaattcatggtgaaatgaccatgtatctcgagaagagagttgaaaaggacaatgaggacaccccttcccatactccaaactctaagttgcatgatcttgtcagtctcaggattgtcagccatccactcccacagccaaatcctagacatgctggagcttcgaaatattcgattataatatcacatacatacacacttattccaaactgcattcctccagccatcactcatcacctccactctgcctttcttcattgtattgtaaagaatgaattgggttagtgtgacagtctttatcagtattcccattactctactactttgtcttcctactgtacctcctgtggaaaaaaattccacatcatcatccaccagaccgtcttctgttctcctcctacacaaacaactctcctacagatgaagaaactcatataactgcattaaaagttcatttgaaaggcatagttgccaaactcagttggaataccacctggtatttctatattttcctgggcaactttctctttcacttcccacagagcatatttcaaacttctattgtgctttagttttctttattacatcaccatatgaaagtgtaattcatttattctgcacttacttactagacatctgttatgtgtcaggcaaagggtgctgggtattatggtagaaaaaagtataacatttgagtttgttccctctcacttctgcctttgttcctaaaagtattcacctatctctgtgcccaccttgcctaggggaagatatatctccctccatgcccaaccattctacctgtactctgttagctcagccattacctcagttagcttatccctctctcctctacctgaaaattctccatcctactggctcactgccccagcagcacttacacttatttatttctgtcctatctttaaccaatcaatatgaccactctcaaccattatgtttgcttctaagtatttccctatatcttctacattcttcagacccgcggtacagttgaccacgctcccctcctcgttcatttcattctctctccagcctcctgcagtttggcatcttcactattctaccgcagcagtcccttccagggtcaacaaagcctctttattagaaaatgcacagggcatttactttcttcagtctttgaactctgcaggcattttgtgtgtgtgtgtgtgtgggtggagacagaattttgctcttgctgcccaaggctggagtgtcatggcacaatctctgctcactgcaacctccacctcccgggttcaagtgattctcctgcctcaccctcccaagtagctgggattacaggtgcctgccataatgcctggctaatttttgcattattagcagagacagggtttcaccatgttggccaggctggtctagaacccctgacttcagatgatctactcgcctcagcctcccaacgtgctgggattacaggagtaagccactgtgcctggccaggcatttctttttataaacggtgtaccctgcctctgggccaccagaggttcctggtcttcttccactcacctctatgttcggttactctgcctgtcatgacatgcggtgatcctctatgttcattcttctctccttacagtttgtgtgttccatgaatgacattatttactccctcaaatccaagtgcatattttatttgtgtgaatccccaataagtaagttcctatggacagaggctgtgcatgttcgttgttttagtcctgacacctatcacagctgcctgacaacccagtgcccagcaacacagaaaaatgcacagactgaataatacaggaaattgtaggctgggcgcggtggctcaggcctataatcccagccctttgggaggccgaggtgggtggatcacgaggtcaggagatcgagaccacgatgaaaccacgtctctactaaaaatgcaaaaaaattagccgggcgcggtggcgggcgcctatagtcccagctacttgggaggctgaggcaggagaatggcgtgaacccgggaggcggagcttgctgtgagccaagatcgtgtcactgcactccagcctgggcgacagagcgagactgtgtctcaaaaaaaaaaaaaaaaatacaggaagttgtaaccaggaggacccactgaaagtggagtgtattctttcactcagtattcactgggaatgcactatacactagttccaatgcttgtgttgggaattcagtgaagagcaagaaagacaaagtagcccctggcacttacattctagtaagggaaatagtcattaaacatatgtactatacagggagtcagagagtgacaagtgccacgaagaaaataaagcagggaagggagttacagagtgatagaaggtaaaagtgcgccagctagttagggtagtctgggaaggaaggctttttggtggcattaaccctgaagaaatgaatgtaatgagaaaatgcctagcggctatttgaaagaaaaccatttcaaaaggaggaaatggtaagtacggtgaagtgggaaaggctttggggtacttgaggagcagaaatcaggccaaagggattggagctgaagttctgattctaggtagaatataggaggcagtggcactgcatcactcccactgcaacaagtagttcaaaaagtaaagaaattggaaatgtaatcgttttaaagatatccgagagctgtggtggcatagatgattagatggactacaagtgaagttgagatgactcctatttccttcactgagaggcaaggtttctgttcagacttgccctaagctgaggtgtttcgccaggggaaagagaagacaatagagcttactttctacgtagcttcattgaggtatgactcatgcaccgtacaattcacccatataaaatttacaattcaatattttttagtgttttagagatatgtgcaaccatccccacagtcaacttttgaacatttttatcacctcagaaataaaagccatggccgggcgcagtggctcacgcctgtaatcccagcactttgggaggccaaggcggacagatcacgaggtcaggagtttgagatcagcctggccaatatggtgaaaccccgtctctactaaaaatacaaaaattatccaggcattgtggcacacacctgtagtcccagctacttgggaggctgaggtaggagaattgcttgaaccctgcactccagcctgggtgacagggcaagactccatcttaagaaaaaaaaagaaagaaaaaaaaggcacatgcttcagctattactccttgtcttcctaagcagcaactaggcttctttctcccagtagattgtcctattgtggacatttcatatgagtggagtcaataatatgtggtcttttgttactgacttctttcagttaacataatgttttcagggttctccatgttgtggcatgtatcagctcctcattccttttttgtgagtaaacaaaaaataacaaaatttaacattttaaccattttcaagtgtacagtactgttaactgtatgcaagttgttgtgcaataggcctctgtaactttttcatcttgccaaagggaaactctgtacccgtggaaaaactccccatttccccctcttccctagctctggttgtcacattctactttctgtttctatgaatttgattactttagaaaacgtatacacagggaatcatgcagcattattccttttatgactggcatatttcatgtagcataatgtgctcaagccttatccgtgttgtagcatacggtaagattttcttctttctttaggctgaataatattccagtgaatatatggtttatacattaatgatttgtcaggagatattagtgttcttccaactcttggctattgtgagtaatactgcaataaagatggatgtgcaaatatcttttcaaaatcctactttaaatttttttgatatatacccagaagtgggattgctggactatatggtagttctgttttaaattttttgaagaacctctgttttccatagtggctacaccattttacgttgccaccaacagtgcacaggggtttcaagttctctatatccttgccagtatttcttattttctgtttctgttttgtctttttggatagtgatctagctaagagatgtgaggtgacatctcattgtggttttgatttgcatttctctgattagtgatattgaacatatttttatatgttggccatattgatgtcatccttaaagaaacgtctattcaaatactttgttaatagggttttttgtttgtttgtttgtttgtctagttttgatgttgttgagttgtaggaattctctatatgtttggatattaaccctcatcggatacatggtttacaaatattttcttctgttctgtacgttgccttttcactctcttcattatttcctttctgtgaagaagatctgaagtttgatttagttccatttgtatatttttgcttttatttcctctgcctttggtgtcatgtccaagaaatcattgccaaatccaaaaacatgaagcttctcccctatatttttatcttactaggtaattttataattttataaattttagttttataaatataattttataaattacagttctataattttaggtcttacatttaggtcattaatccattttggtttgtttgttgttttgagacagggtctctctctgacaaccaggctggagtgcagtggcatcatcacagctgactgcagcctcaaccttctgggctcaagcaatcctcctgccttacccccacctctcccagtaggtggcactacagggtgcgcgccaccacacccgggggaatttttacattttttgtagagacgggtttgcagtgttgtccaggacttgagcgatcctcccacctcagcctcccaaagtggtgggattacaggcgtgagccactgcacctagccgttaattcattctgaagtgatttttatatataggtacaggaaggtaagggtctaacttcattattttacatgtgaatatcaagttttctcagcaccatttgttgaagacactatcttttccccattgtatagtcttgatgcccttatggcagattattttaccatatgtgtgagactttatttctgggctctctattctggcccattggtctatatgtgtgtctttattccagtattatgctattttgattactgtagctttacactgttttttgaacttgagaagtgtgagacctccagatttgtttttctttctcataactgtcttgactatttggaatactttgagattcctaatggattttggattttttttctgcttctgcaaaaaattccaatgagatttttatatggactgcattgaatctgtagatttgggggttagtatgaacactgtaaccatattcttttccaatccaggaacatgggatgtctttatatttattcgtgtcttcattaattactttcagcaatattaagagtattcagtatacaggtcttttgcctctttggttgggtttattcctaagtattttattctttttgatgctcttgtaaaggggatttaaaaacatttccttttctgattatttattcttagtgtctagaaatgcaactgatttttgtgggttgattttgtttcctgcaactttactgaattagtttattagttgtaacagttgtctgtgtgtgtgtgtgtgtgtgtgtgtgtgtaatccttcaggttttctacatgtaagattatatcatctgcaaacagagataattttatttcttcctttcaaaattgaatgctttttactcctttttcttgtctaattgctctgactagaactttcagtactgtgttgaatagacgtgacaagactgggcatgcttgccttgtttctatttgtagagggaaagcttgagtatgatggtagctatgggcattacctatagggcttttaatatgttgatgtaattttcttttatttctatattattgaattttacatgaaagggtgctgaattttattaaatgcttattattgcactaattgagatgatcatgtgacttttttacctttctgtcagttaatatagtgtattgcattgactaatttttgtatgttgaaccatccttgcatcccaggaataaataccacttggtcatagtgtactgctgaattaagtttatgatattttgttgaggatttttgcatcaatatttagcaagattattggtgtgtagtctttttgtggtgtccttctttagcattcgtattaaggtaatactggcctcataaaatgagtttgaaagtattttttcttctgaaatttttcagaagagtttgagaaagagtgatgctaactattctttaaatgtttggtaaaactcatcagtgaaaccatctagtcctggggcttttcttcattgggagatttttgattactaattaaatctcctaagttatagatgtgttcagattttaatttattcacaattcagtcttggtaggtagtatatttctaagaatttatttcttctaagttatccaatgtactggagtattgttcatagtagtctctcataatctttttacttctgcgtcctcatttttaatgtctcatttctgatttgtgttactttagacttctattttcttacttattgaaagaatttgttaatttttttatttttttaaaaaactcttatttcattgatttttctatttttttaatttattctctatttcatttatgttttctgtaatctatgaccttccttttgctaactgtaatctaggaccttccttttactaactttggatttagtttgctattctttttctagttctttgagatacaaaattatctccaattattgattggggatcttcttttaaaaatacaaacatttactgccacagttttggtgtgttgtgttttcattttcatctgctttaaaatactgttaaatagtgatttcttgactcatcaaattgttcaagagtatattgcttaatttccatatctttgtgaattttctggttcagcgttttctagtccagatttctagtttcatggtgattagaaaatatagttggttttctttcagttttttttttgaattgttaaaacttgttttgtgtcctaatatgtgttctgtcttggagactgttttatgtgcacctgagaagaatgtgtatattaacatagggtggaatattgtttatatatctattagattcaattcacttttagtattgttcaagtcctttatttccttattatttttctttccggttgatctatttattattgaaagaagagtattgtaatctcctcctattattttttttaatctaattcttcctccagttctatcaatgtttgcttcatgtatttgggtgctctgctgtttggtgcatatagacttataagtgttgtactgtgaattgacactttcatcaatacgatgtgtattgtttttctcttgtgacagtttttagcttaatgtctattttgtctgatatatgtatgggcacccttgctattttggttacctcttgcatggaatatatttttcgattccttcattttcagcctgtgtgtgttttcaaagctaagtgaatctcttgtagatagcatgcaattggatcttttaaaaattgattctgccactcggtcttttgactgcggagtttaatccattcactcttaaagtagttattgatggggaaggacttactattgcaattttgttaattgttttcagtatgtcttagagttgtttgtccctcttttcctctcttgctgcctttgtgtttcattgattttttttgtagtgatatgctttgaggactttcttattttctttggtatgtcttctatagcaattttccctgtaagttaccatggggattatataaaacatcttatagctataacaatttatttaaactaaaaatttaattcaattgcatacaaaacctctactcttttacctccaattcaccttacattatcaatgtcacaaattatacttttagtattttgtatccattaatataatttaataattatggttatttttatgcttttatttatacctgatttaaaaatgatttatggaccactattgtagtatgacaagattctgcattttttttttttttttagacagagtctcactctatcacccaggctggagtgcagtggtgcaatttcagctcgctgcaagttttgcctcctgggttcacgccattctcctgcctcagcctcctgagtagctgggactacaggcgcccgccaccatgccctgccacttttattttattttttatatttttagtagagacggggtttcaccgtgttggccaggatggtctcaatctcctgacctcgtgatctgcccacctcagcctcccaaagttctgggattacacgcttgagccactacgcctggcctagattctgcatttgactatatgtttacctttaccagagagccttatacttttgtatgctttcaagttggtatctagctttcttttatttcaactgaaaggactaccattagtaattctagcaaggtaggttaatggtgacgaacttcttcagcttttgtttatctgggaagatctttatttctccttcatttttgaaggggagatttgctgtctattcttagttggcagttttctttctctttcagccctttgaatatactaccccattccctttcagtatggaatgttcctgctgatgagtttgctgataatcttatgagagttctcttgtatataagtcacctttctcttgctgctttcaagattgtctgtcttggacttttgactgattataatgtgtcatggtgttggatctttaggttcatcttagacagagtccttcaagctgctgaaatttggttgtccatttcctttttcagatttgggaagttttcagccatttcttcaataagctctctgccacaggctactcttcgttgtgcaatctgtggacccagttgtcatctgccaccactgtctagttatcttttgactgccacaagtggactccaaaaaatctccaaaagaaattgttaccataacaagatggccaactagacacagccagaaagcactgctcccactgacagaaaccaaaatattgagtaaaccaacgtattttgagcccatcttcagagagaaaatgctgagagtcattacagacatgatgcagacaacaaggctgaagagggaggaagctgggaaccctgcacaggatacttgcatgacagggctagttcccagacctgaatgcctcctggggaagagataagtgaagggatggagggacaggccactctcactgtggacctctgggatcctaggtacatagaacttcacattctccatggccttttgagctggcaggggaatcttcaaagagagtaggcagagacagggcttcactggcatggagcctaggagcttttgtgtatgtggcagctgtggcagagcatggcctagacacccatcccccagggctccccacctccctacaggcagctctagcctcagctgattgctggcccaggagagagtgtggctggcttccctgtgggactgggaaacttccagggcccctgcctggccaccctgcaggaggtgtgcacagagtagcctctgctgccaagcctgggtgctttgcttcacctgagtaccttcctggtggcctgggagcactttggatcccccagaacagctggggcccaatctcaagggtctggaggatgaagctgaaagccagtcctggctccccaaaactacacaaatacatggaaattgaacagcttgttccagagtaactcctcggtgaacaataaaattaaggaagaaataaaaaaattctttgaaataaatgaaaatagggacacagctgaccaaaatctctgggacacagctagaacagtattaagaggaaagtttatagcactaagcaccttcagcaagaaattagaaaggtctcaaattaacaatgtacctttgcaactagaggaactagaaaaaaaaaagccaaccccaaagcaagcagaagataataaatatctaaaattagagaagaactgaatgaaatttagacacaaaaatccatagaaaagatcaatgaaacaaagtgttttttcttcagaagaataaacgatcaataaaccactagctatattaacaaagaaaaaaagagaaggtctaaataagtacaatcagaaatgacaaagaagacattgcaactgatcccacaaaaatacaaaagagcctcagagactattatgaacagctctatgtacacaaattaagaaaacctagagaaaatggataaattcctggaaacacacaaactcccaatattgaaccagaaagaaaatgaaaacttgaacagaccaataagttccaaaattatatcagtattaaagaaactgccaaccacaaaagaaaaaaaagaaaaagaaaaagaaaagccctggaccagatggattcacagacaaattctctcagacataaaaagaagaactggtaccagtcatattgaaactattcaaaaaaattgaaaaggaagggtacctctctaacttaccctacgaagccagaatcagtctgataccaaaatctggcagagacacaacaaaaaaagaaaacttcaggccaatatacctaacgaacataggtgcaaaaattctcaacaaaatactaggaaactgaatccagcagcacatcaaaaagttaatttaccacaataaggcaggctttactcctgggatgcaaggctggttgaacatatgcaaatcaataaatgtgatccaccagagtaacagaattaaaagcaaaacccatatgatcatctcagtagatgcaaaaagagctttcaataaaatccaacatcccttcatgataaaagccctcaacaaactaggcatctaaggttcatacctcaaaataataagagccacctacaccaaacccacagccaacatcatactgactgggcaaaagccagaagcattccccctaagaacaaaaacaagacaatgatgcctactctcactgctgctattcaatgtagtactaacagtcctagccagagcaattaggcaagaggaagaaataaaagacatccgcggctgggtgtggtggctcacgcctgtaatcccagcactttgggaggccgaggtgggcagatcacgaggtcaggagatcgagaccatcctggctaacacagtgaaaccccgtctctactaaaaatacaaaaacaaaaacaaaaaacaaacaaacaaacaaaaaagacatccgcatgggaaaagaagaggtcaaattatctctcttcactgacagtgtgattctctctttttttgaaactgagtctccctctgttgcccaggctggagtgcagtggcaccatctcagctcactgcagcctctgcctcctgggttcaagtgattcacctgccttagcctccagagtagctaggattacaggtattcaccaccacgcccagctaatttttgtattttttagtagagatggggtttcaccatgttggccaggctggtcttgaactcctgacctcaagtgatctgcctgcctcagcctcccaaagtgctgagattacaggtgtaagccaccatgcttggccactgataatatgattctatatctagaaaaccctaaagactctgccaaaaggcccgtcaaactgctaaatgacttcagtaatgtttcagggtacaaaaataatgtacaaaaatcaatagcatttctatatataactgagtacctcagcctcgaaatacatttttaaactatttttttcctttccttcctaatctcagaatgtagccttatagtgtaagactctttgttatgccctttcccaacaggcatatctgtgcacagtgcttgctcatctaactatgtgcttgcttagaaattccaggagccaattttgaaacaaaccaggcagagataccaggccgcagatcttcccactcaaggggagttacgcccaagtcaggatgatgcaaatcagatctctagatgggcgattacttgagataactatgggaacaagacatgcagctatgcactcccttttcactactcatgtctatatcccacacctttttccttcttaaacccgttcactcagcccagaaggctgagatggctcttttgaggcttatgcccagacattctcccatctgctagaatttgaccaataaaagttgctttcctttcaccacacgtcagttcttatgctttgacttctgagagaagagcagctggacttgagctggttacatatacaccaataatgttcaagctgagagccaaatcaagaacacaatcccatttacaatagccacacacaaaaatgaaatacctaggaatacagctaaccaagaaagttaaagatctctacaaacctgacaatgttggtgttgtcgtgtttggaaatgattaactaattaaggaaggaactagagtgaagaggacaggagccattgtggacattccagttggtgaggagctgttgggtcatgtggttgatgcccttggtaatggcattggtggaaagggtccatttggttccaagacccataggcgagttggtctgaaagtccctggaatcattcctcgaatttcagtgcaggaaccaatgcagactggcattaaggttgtaaatagcttggtgccaattggccatggtcagtgtgagctgattattggtaatggacagactgggaaaatctcaattgctattgacacaatcattaaccagaaatgtttcaatgatggatctgatgaaaagaagaagctgtactgtgtctatgttgttattggtcaaaagagatccactgttgcccagttggtgaagagacttacgatgcagatgccatgaattacaccatcgtggtgtcagctatggcctcagatgctgccccacttcagtaactggctccttacactggctgttccatgggagagtattttagagacaatggcaaacatgctttgaccatctatgacaacttatccaaacaggctgttgcttaccatcagatgtttctgttgctctgccaaccccctggttgtgaggcctatcctggtgttgtgttctacctatactcccagtagctggagagagcagcccagatgaacaatgcttttggtggtggctccttgactgctttgccagtcatagaaacagactggtgatgtgtctgcttacattccaatgaatgtaatttctgtcactaacggacagatcttcttggaaacagaattgttctacaaaggtatccaccctgccatgtcggtctgtgtctcctgtcggatctgctgcccaaaccaggtctatgaagcaggtggcaggtaccatgaagctggaagtggctcagtatcatgaggtcaccacttttgcccagttcagttctgacctcgatgctgccactcaacaacttttgagttgtggtgtgtgtctaactgagttgctgaagcaaagacagtatactcccatggctattgaagaacaagtggctgttatccatgtgggtattaggggctatcttgataaacgggagcccagcaagattacaaagtttgagaatgctttcttgtctcatgtcagctggcaccaagccctgttgggcactaccagggctgatggaaagatctcagaagaatcagatgcaaagctgaaagagattgtaacaaacttcttggctgaatttgaagcttaaacgcctgtggatttacatcaaataccagttcagttttgtcattgtttattctagtagattagtttcatttgtgaaagggttactctcatactccttatgtacagaaatcacatgaaaagtaaaggttccataatgtgaaaaagaaaaaagatctctacaaggagaactgccaaccactgctgaaagaaatcacagatgacacaaataaataaaaaaaaattccatgctgatggattggaagaatcaatattgttaaaatgaccatgctgcccaaagcagtttaaagatttaatgctataactaccaatgtcatttttcacagaactagaaaaaactattctaaaattcatatagaaccaaaaaacagcccgaatagctaaagcaatcctaagcaaaaagaacaaagctggaggcatcacactacccaacttcaaactatactataaggctacagtaagcaaaacagtttggtcctggtacaaaaaaagacagatgaatggaacagaatagataatccagaagcagttctgcacacctatagccatctgctcttcgacaaagcccacaaaaaaatgggaaaagggtcccctattcaataaatagtgctgaaataactagctagccatatgcagaacaatgaaactggacccctaccttttatcgtatacaaacattaactcaaaatgaattcaagatttaaatgtatgacctcaaactataagaatcctggaagaaaacctaggaaaaacagtattctggacatcagccttggcaaagaatttttggctaagtccccaaaagcaattgcaacaaaaccaaacactgacatgtgggacctaattagactaaaaagctcctgctcatcaaaagaaactgtcagtaaacagacaacctacataataggagaaaatatttgcaaagtatgcatctaacaaaggtctaatatccagaacctatgaggaactcagacaaatcaagaaaaaacaaacaaataaccctattaaaaaatgggcaaaggacatggacagatacttctcaaaagaaggcatacaagtggccaacaaacatatgaaaaaatgtccaacatcagtaatcatcagagcaatgcaaatcaaaaccacaataagataccatctcaccccagtcagaatggctattatgaaaaggtcaaaaaacaacagatgctggtgaggctgtgtgtgcataaaagggaatgcttataaactgttgaggggaatgtaaactggttcagccactgtggaaagcaattgaagatttctcaaagaacttaggactaccatttaacctaccaatcccattattgggcatatacccaagggaaaataaatcattctaccaaaaagacacatacacttgtatgttcataacagcattattcgcaatagcaaagacatggaattaacctgggtgcttatcaacggtagattgaattttaaaaatgtagtagtagtacatatacaccacagaatactacacagccataaaaaagaatgaaatcatgtccttttcagaaacatggatgcaactggaggccataaccctaagtaaattgttataatataggaatggaaaaccaaatacagcttgttcttacttgtaagtggaagctaaacactgagtacacattgacataaatatggtaacactaggcactgtgaactactggaaggggcaggagggaggggagatgggttgaaaaactgcctgttaggtaatatgctcactacctgggtgatggaatccatatcctaaacatcagcattattccacatacctgtgtaaaaacttgcagctatatcccctgaatataaaataaaatcaaaattatttttttaaaaagaaattgttgtcattacaggaagtggtagatattttgggttctgcctaggctgtttctgaatcagaagggagtccatatgattctgtttgacataagtatccctgctcaaaccattctggaaggaatcaactttatacatggagacatctgtcatctctctgaggtagagaaagccttccaggatataaatgttacctgtgtgttccatattgtcttttatgttatgtcagggtggaaacaattgaatcaaaaactgctggaaaaagtcaatgtgggggacacaggcaatgtcctccaggcttgcaggaggataagagtaataaaattagtttacactagtgcttttaatgcatatttggaggtgaaatggtcagaaatgaagatgaatctgtctttcttagctcttcacctctaaagcaatcactactctcagacaaaattgactatggacaaaaagatagtggaagtaaatggtgtttttcctcccctacatcactaacatcctgaatcccttcccttaagtctgtgaccactgggatacttggtcccactaagatagctttcctccactatgattcctcatctacatgttcagtgtcatcagaagaatgatgtccttttccagatagctgaattacgcagcatttaaatttatcttatttcattttttatgagaagttataatattggaataaaaagcagaaacaaggaaagagattttctgaagtatacattttatatgagccaaggaattagtacctggaaaaataaactgtgatgtttaaaattagtttatatatggagataattatgtttcttgctaaaatgcctatcaccctactgattctcaatttgaaataagcattataacttttacatgtctgaatatgaaattttacaaatttgacaggagaggccagagaattagcttgctctttttccaccatgtaggaataaaataagaaatcagcagtctgcaatcagcagttactggaactcaaccatgctgatgccttgatcttggacttcccagccaccagaactatgagaaataaatatttcttgtttaagccacgcagtttatgataatttgttatatcagcctaaactgattaagacaaaaatgctaagaaacagaaggaccacatagtaaaattccataaactgttctggaattttatatctactactaaggtctagaatccagtaggtcctcatggattgaatatggcaccagcaagggggatgtggacatgagccagatcctaacacaaaggatatttgccctcagacctcctttatggttccttccaggagtgtgcagcccagaataaaggtttgatggagtgactggtgccacaggtatgagcaatcggctcataatgggggcaacagtttggaatcagagaatcatgattattcttgtaaatgatacttatggaccaaagaggcacattgggctcagaacatagcattttttcccctaggtctgtcagcctatatatcttttacaggccaggtatgtcaagagtctacatttgggagaggtcataaaatccatataatatacattttgtacacaatttcagaatttgtaacagattatactcaagatactgcattttatctagtgtgtttttacattataatttcacagggtaacagcttctcattttcaatgctaggttacttttatgtgatattcacattttgtaccaatctggtgttcagattttatattgcttgatatgattttttaagtgcataatcactttcttaaagtttctgtttaaaaacttatgggaagcatgacataatataaattatattagagatggaatacttaatatcccctaaaataccagataacttagaccagtatcccagtatttaaatatatagttgataactcaaagtaatttatcactgtttctctgtaatcattttgatgtcacaggttgtttaaggcttaatgatgattaagaacatttagtgaatttatgaacactttaatgaattgatttaacatttcagctgtttatgtgcaaggacccataaaattatcaatttaaatgacttgagaattaaaatataatagtttattcttggagcatctctttttctctctccagttattggtcaggctatcaaatgcttttttaaaaatctaagttttaaatatttttatttatttatttattttgagatggagtttcactcttgtcgcccaggctggagtgcaaaggcatggtctcagctcactgcaacctgcacctcccgggttcaaatgattctcctgtgtcagcctcctgagtagctgggattacaggtacccgccaccatgccccactaattattgtatttttagtaggggaagggtttcaccatgttggccaggccggtctcaaactcctgacctcaggtgatccgccccgattggcctcccaaagtgctgagattacaggcgtgaaccaccatgctggcctagatatttttacatgagattgtggatgataatctcattttgggtagatttgtattctgggtagatttttatcagggatcctgatttaaaaagaaaaaaataaattttttttctggttatgattagcatttttcattaattaccacctattttagttaaggtagctctatttaattcatacaacattttatttgttagtgcatggtgcaattaaaacaatagttacaatgtcatgaaggacctgcgccaagaatcacatgacaccacatagccatcagtacctatgacaatgctacttttaaattctcattttttaatgagaatattgaggctccaagatgttaagtaactttcccaagaatacacagctagtagattcagatttataaggccacaaagcctgggttctcagttactactctgctcactggaacttgtgggagcaaattctgatcaacttataagctcttcttccccaaaagatcttatcttggagaagaaggagacctctatactgcagagctaaagttttgagtaggtcgtgcttgacttctggggcatgaaaactggttttatgaaggtaaaatcatcagcatttccatggagcatcttgtgtttctcagggcatgggaaccaaccatctgcagtataaagtaaatttttaactcataagtcaatggaattgttgttggtatggatatcaccatattatttggcaggtgattcttttttttttttttttttttttttttttttttttgagagtctcactctttcgcccaagctggactgcagtggcgctatcccggctcactgcaagctccgcctcttgggttcatgccattctcctgcctcagcctcccgagtagctgggactacaggcgcccaccaccacgcccggctaattttttgtatttttagtagagacggggtttcaccgtgttagccaggatggtcttgatctcctgacctcgtgatctgcccgcctcggcctcccaaagtgctgggattacaggcgtgagccaccgcgcccggcctaggtgattcttattgaaatatcataaagggcaagtattgtgacaacttttctccatgattaataaaacaaacagataatctttataatactaatcattgctgtttctttataaaatgttcttgattacttaaagtactattaaattaaaaatcagatttttgcaacatgtagaaggctcttttaaaaaaactataatattattctatgttgtatttctgtaggtataatatcacatcaccataatctgcatggtctaataaaataatagactgtttctcaataaatagctttcccacaatatggaaacattggcaatgttttgttttgtttttttgtttgttttgttttgagatggagtctcgctctgtcacccagactggagtgcagtggcatgatctcggctcactactacttccgccttctgggttcaagcgattctcctgcctcagcctcctgattagctgggactacaggcatgtgccactacaccaggctaatttttttgtatttttagtagagatgaggtttcaccgtgttagccagggtgatctggaactcctgaccttgtgatccacctgcctcagcctcccaaagtgctgggattacacgcatgagccaccacatccagccggcaatgttttttaacatgtagtttagtcttcagaccctctcaaattacttactgaactaaagtatgccttttataagaaacaacattcagtaatataaaaataaactctcatctcttctttactttccatttaatttaaggtacattttggaggacattcttgtgcttacttcatgtaacctcacttgcttttaggtgaattcaaaattctaatgttaatcccttgtattagggttctctagaggaacagaagtaataggatatatgtatatacgaaagggaatttattaaggaatattgacttggatgatcacaaggtaaaattccaggataggctgtctgcaagttgaggagcaagcaagccagtggtggttccgtctgagtccccaaacctcaaaagtagggaagctgacagcgcagccttcagtctgtggccaaaggctcaagagcccctggaaaaccactggtgtaagtccaagagtccaaaagctgaagaacttggagtctgatattcgagggcaggaagcatccatcacaggagaaagatgaaggctggaagactcagtagtctgctcttccatcttctcctgcctcctcgctggcagctgattagatggtgcccaccagattgagggtggatctgcctctcccagaccactgactcaaatgttaatttcctttggcaacaccctcacagacacacccaggaacaatactttgcatccttcaatctaatcaagttgacactcaatattaaccatcttcttactgagcagttaactcataataacactgccaaagagaactctaacagttaacagaagcgtcgtttgttgtcctaagtctgtcataatattctgtataacctttgaagaaacatttaaattttcctctttcaagcaatgaaatatgcattccttaaattgaaagaacatgagcctccttgatgcgttgcctgacatggtgggaaaggtgagcccctgagtcggaggactcaccccggatcccattctctcacaggcttgtgaaagcagaagtcaccttccttctgaccttggcatgtatcctgcttcaagaatggaactggaggcatatctattcttattacaaagaaaatttaagtcattctcctatagaattttaatttcaatcattgttttaggaatttgcaaatatatggcttgctttgtcttaactaatagaaaaagtgtcctttttcaaaaagagaagtgttaatgtaatgataatagtaatgacttcacagaatgtgtgttctgttccaagcactttaagcatattaacaatttaatcctcacagtaatccttggaggatgatatcatcctgattttgcaagtgagacaactgaggcacagaaaggccaagccttatatagcagagctgggatttgaacccaggatgtctggctcttaatgctgttagtttacattcttaactgtgggccagatgtgtgtaactgactatcaaacgtggttctgacacaaaattctacatctaaattccaatctccattttacatttctgctaacctgacgggggaaaaacttttattttaatatgaccagggatccacattttgaaaaatattgccagtgcagtcctgacagccacttcttcattcttaagcacctgggaggaaactgttcagaagtggttggttatgaaatggtaaaatcagctctgccctgctgatgaatccagaataattaccaatgactaagtccagcctcatgaccacttcttgagtgacattgagtttgcatcctaatttgaagtttacaattctggcaagatattggacagctgcagggataattttgttcacaaatatagatgcaaaattctatgctgcgttaaagctattttaaagagcatattttaggactagtgtttatttccttgtgtctaaatttcctgttttgcatttgcttcagctaagattgttttgggctaaacttatcttcctacacagacccttgatatcatgtaaatcaaaataatcataggcatatttaattatatgacatttgttgtctctacactaaagtttttctaacattcttaaattttgtctacataatgaatatatttttaacagaaaaaaaaactataggtttgattgcctgcttatttaaataaaaagagaaagaagagatagaagaactatgaactctttattggttgccaaacaataaaaatacctttttgggaaaaaagtaaaccccattgtttccttgaatgtgcttgttctttcagctcagtcctaagagtggatgattactgagcacagggccctgagatgaactgagggactcacatctcattcaagcctcacaaagcagtggaaggattaatgttttcttcattttataaagagcacactgagactaagaatggttgactagtttgcccaagttctcaagagtagtaaaattttgagccgttaatttaaaacagaccatctgtaggtagactagagctgagaatgatctcaattaaaggaaggaattctgtcactttgtggagttttatgaagagataagatagaaaccaacctactgagtattaaacaaaaggctatttcccgaaaacatccttccacattcattcttcaatcagtaaaattttactaccattaaggcagaaaaagggttagacacaattccttccttcaagaagtttagaggttaatagggacactacaatattcgtgacataacttaaaactacataaaaatggtatagaaaggtaaagatttctctgtgaaagaggtataaaaaagaaaatattttcctcatggtaagcttgaagtttcttcctccctgggaggcttaaaggagtcttcgtgatggagatctagaatccatctttagttggttagtgtgtgcacatatgagagggaaggccatgctgggcctgatccaacaatgaggctggaaatgggtgtacttttaagaaaatgaataaataaataaatgatcttgtttgcctaggagcctgcaagggactaatggaagctgtgaatagaaagaccctttggaaccaatttggagatgtccttgaaaacgaggggagtatagaattttctccaaaagaaaataagaaacctttaaaggattgtatctgcggaggggcaagatagtaacaaaatcttcgaagaggaaataagcctttacctcaccgctgttcaccttgtttgagggcttacctttcacagcatgggcccctgctcctggccctccctattgcctaggcagagtttcactcttagcctctgtcaagtgtgatcaccagctgacttatctatatctttttttttttttttttttttttgagacggagtctcactctgtcacccacgctggagtgcagtggcgcaatcccggttcactgcaagctccgcctcccaggttcacgccattctcctgcctcagcctcccgagtagctgggactacaggcgcccaccaccatgcccagctaattttttgtagatttagtagagacggggtttcaccgtgttagccaggatggtcttgatctcctgacctcatgatccacccgccttggcctcccaaagtgctgggattacaggcgtgagccaccatgcccggccatctatctcttcttatcagtaattgggcagtcttgatactgagcttcccagctgtggacccacaactaaattaatgtaagacccaaagatctgaaacgccctttaagatgccaaccttgagaataaagaatgttagataccagcagaggtttatgcaagaagaagatggagtggtggagaaaaactgggagtaagaaaattaaaggaagagaaaataatagaaaagaacagtgatcatttgtattaaataatgagagtgaaaatagggctaacagtattttacaggtgtagtggatcacaggttgttgacatgtaaccaacaagaactggacgatatggctgcaaccctttgtctgcaaaagctcacatgtattggctagtaatgttcaagtaattaagaggacattaatcagttaaatatctatccacacatgttttctctaaaaaaattcaagtctccattttttttctgtctaatacttctgacttcaaggatagaatcaagagaactgggaccaggaattgcaactattgcaatgaggcaaatccccacaatgtcccaggtcagagttgagagaggcagctaaacaatgggactgtacccacctatgacatgaccttttaaaacagctctttttttgtgcttctttagatggatagaagtgaacttatatctatgctttgatttttgcaaaattcttagtctgtaaaagatatagttgtgactaggagactaactctcatttgcctcagtcctaaattcagtgtgttcagtataacattgaggaaataaaaatcataataatgatttcagaagtgacatattaactccatatttttgaaagaaagtgtggtcaggctctgtgctaaaaaaaattctacctactgatgttgcaaaagcgtgtcttgagatgatctttataatgaaaactagatttctgtgaatgtgcaatgacttttgggtccttttcttttcatattcaaatattatttcccttctgtgatatttccccttatttatgggtttctttaatcatatgcatatattttttatgttgaaacctagtaaaggtataagcttttgtttcatttttagcatgaacctaagaagctcttccatcatgatctatggctttcattattgattctgtttatagacaggatataaatataatatgaaaatcaaaaacaagttttaaacaaaaattgtttttaaaattagatttttctcttcaacttaaatattttacccttccaaagggtgagggaagggggaaagatgaaagtggcagaattaatgtagaaataaaatgtttggagcagagcttgggctttttcccatagagtgaatactaaattttatcagtataatgatccatcacagtttaaagaagcaacacattttccaattacaatgataacttttaacatatctaacattttaacatctctgtatcttctaatatattagacttgaaaaattctgtagtgattgcttgtctcagcattttgcaaacatcatccttgctgtaccaaaacagagttcgccagttttggaaagatgtgtgcgtggctgaacctcttctgggactggacaacggacagcaactactatacgtgcaagtagttgttctctggtgagctgaaacagttactcacatcacttcccatgctctgaggttcagatgaggagcgctggtagagaaaggcagctctagatctttgtaagaaggtaataagacacgaaactgtgcccttcaatggaaagtattaatataatacgtctctccaaggaagggctgacaatgggagttgaaagccaccagacagtaagtggctctcaaaatgagtgggaaggtagttacacaaagttggtgcccccatacttgtctggaggcctagctgaagaaccaatcctagcatgcccctccaatcatcgtggccactctaggaaccagccctagccacagccctactaggcaagagttgtcatgcttcttttacaaacttcgagtagacttaaagttttccttttgtcttcttcaccagagaaagaaaaagtttacttttggacaggttgcattaaagcactttagatattctcttttctctggtggaagcccgtatcttaggagacatggggagcctgctgctggctcacctgtcacagaactggatcatgaagctttcatctggtttttcccaggtgggcattttaaatttctgcttcaaagtctgtctttgtacttttaataaataagacatttgtactgatggaatctgcaagacaggcttgaaggaaaaaataaatgtctcaaagtgaaagtcagtttctttttacatgaacagtcatgtaaaaaatgtattaaaaatagcctttttgacttggagatctattatgttcagtagctaaactataacacagaagaccacatggagcacatacatgaaatattgttgaggtggccatttggagtcctgggttctagtaaggactccacttcaattggccgcatgatccaaggatgggcatatcacttctccaggacttagggtcttcatctctaaagtgaaggctgaacataacaggtacccttaaagctgcaaagcatcacacaacatttcacacctgtttaccctctcattctcttagataacactttttctctcttttctctttcctcaaaatgccagtgtctcttctcccagtctcattcttagctccctacttcaccagaaaactgaggcaatcaaaaaagaatgtccatgagcttccaacatcacattggcttatggctctgatctgaatgtgtctcctccataattcaggtattgaaacttaatggccaatgtgacagtattaaaagatgggcctttaaggccatgcgggttcctccctcatcaaagggataaaggtctttctaaaagaggcttcacacagcgtctggccctcttgccatgctaccttctgccaggtgagaatgcagcgaaaaggacctcaccagatgccaaaaggacctcactgtctccttgatcctgaatttgtcagcctctagaactgtgagaaaattaatttcttttcttttcttttctttttttttttgagacagagtttcgctcttgttgctcaggctggaatgcaatgacacaatctcggctcactgtaacctccgcctcccaagttcaagagattctcctgcttcagcctcccaagtagtgggcattacagttgtgcgccaccacgcctggctaattttgtatttttagtagagacagggtttcaccttgttggttaggctggtctctaactcctgacctcaagtgatccactgccttggcctcccaatgtgctgggattacaggcatgagtcactgcacccagccaatttcttttctttacacattactcaggctgtggtattctgttataataacacgaatagactgagaccaaaattgataccaggagaatggagtgttgctacaacaaatacccgaaaatgtagaagcagctttggaactgagtaatgggtagaggctggaaccgttttaaagggaatgctgaaaaagcctgtatggcccaacatggcacattaagggtgattctggtgagggctcagaacaaaaggagagctgtagggaaagcctgaaccttcttagtttatcttagacaagttcttatattatctcagtggttgtgacgagaatactggtagaaatatggacagtgagggcctttattatggtatcttaaagagaaatcagaaacaccttactggaaactggaagaaggccatcactgttacaaagtagccaagaagttggctgaattatgttcctgcctcagtattttgtgggaggtagaacttaagagtgatgaactaggatacttgatgaaagaaatctctaagcagcaaaatgttgaaggaattgcacggcttctctcaactgctcatagcaaaatgcaaaaagagagaaatgacttaaagatggaatttataatcaaaagggaagctctcacatgtaaagaatgtaaagatttgaaaaattctcagcctggccatgtaaataataaaaaagcatgtttagtagagaaaaccaagggtgtgcccagttgacagtccgataagcaaattagtgtgaatagcaggaagccaggagcaatttatcaagataatgagaaaatgaccccaaagacatttcagagatctttgaggccaccacattcttcacaggcagagtgctagggccttgggggctgaacaggtttgagggaggggcccagggtgcccatgggaacttggggcttaccatccagggccgcctcaaatctctgctccctgcattctggcacagtgctccttggctgccccagctatggctcaagcaggcccaggtgtgactcaagtcactgcttcaggaggtataggccatagcacttggcagcacccatgtagtgcgaactctgcaagtgcacagagttcaggagctttgaaggcctagcttcctcccctaggtttcagagaatgccacagagtgtctccaccagaggaatacacagtggagctgtgtgagtggggccacctcagagagtactcactaacacaaaatctagtggaactatgggggtagggccatgctggagacctccacattttagagtcaccaggatgcaatgccagcgtgaaagagctgcaggtaggagactccaacccatgagggctgtggtgtgggctgtgcccagcaaagctatggggttgtggcctttggagccttggggatccaacccctgccccagtctgccttgacggtaaaacatgagtcaaataaaattattctcaagccttaagatctaatgttgtttgcccttttgggttttggatttactcagaacttgttacccctttcttttagccaatttctgcctttcaggatgggaatgtctatcccacacctataccaccattgtgttttggaagctaataacttattcgactttgcagcctcattgctggagggaaatttgcttcaggatgaattgttccttgagtctcactcatacctgatttacataaacctctggactttagacttttgagttgttgttggaatgaatgaaaacttttggggctattgggatggaattaataatgtattttgcacatgagaaggatatgaattttgagtggccagagaagaatgctatgatttgaatgtatttctgccaaaattaatatgttgaaacttaatgaagaatgtgatcatattgagaggtgaggcctttaagaggaattaggccatgaggattcctcctccatgaataggattaaggactgtcttagtccattttatgctgttacacagaataccacagactgggtaatttataataaatagaaatttattggctcactattctggagctggaaagtccaagatcaaggggctgactcctgcctagggccttcatgtgtgtcctttcatcgtgaagggcataaaaaaggggtgagagagaaaaaagcaggccaaataggtccttttatagggagcccactcccacaatagcagcattaatccatttatgaaggcagagccctcatagtgtaatcacctcttaatactattttaatgataattaagtttctaacacatgatttttgggaggacacattcaaactgtagcaaagcccttaaaaaacaggctaaatgcagcatttggctctcttgcccttctgccttctgtcatgtgcacaggcagcaagaagggcctcaccagacatcaaattctggcatcttgatttcgggcttcacagtttttatacctgtgaaaaaattaatcacccaatctgtggtcatctgtcacagcagcacaaaatgaacaaagacacttacccaccagtacctacaccctcagagtctgccttctcaccttttaacttttaaccttttaactacccttacacatatacaaagctcatacttcacctattcaaaaatagaagtcgcaagattagctcacctctggcctttggatttttccttggaagattctattagcatccagtcctgctatattccctatccttaagggcacgacaacaatagaacacaaacaaaaagaaacttttcttggctttactttctctgcgagctcctgtcccatttctattctcttttgcaacacaattccttgaaggagttatccacactcttttaaaatatttttctctgttattcttgtaaacacagtccaatcagatttttcagcactccccctacactgctcttgtcaaagtgtccaacaaacctcacattgctaaaatcagtggtcaactctcaattctcacattactcacactatctgcagcatctgatataattgattacgactcttccttgttaatttttttcttgtttcagtcagtcttttggcattagttccatccatatgccactgacttccaaatgtggctctcttagccaacacctctctcccaaactgcaaactaaaattccaaaaggcttatttgactctttttagatgtcttagagatatctcaaacttatcaatgttcaaacctgaactcctgatctttgcattcaaaactttgtttacctgtaaacttcctaatctcatctggtggaaactccattctcacactagcttacaccaaatatttaagagtcagactcatttgatggtctcttatgagctcacacttgcagtttcactcctatggagctcagccagggctagaacttccattatggtttaaatcatatggctggtagttgtgctgactactggctgactctggggctctgttctcctccgtcagtctagcttagctttctatcagcaaggcagctgcattccaagacataaaaaatggaaggtgtggggattcttgaagttttgtctttggagttgcacattgtcatttctaccacatgatattggttaaagcaactcataagattagtccagatttaaggggaggtaagacagattctatgtcttgatggaaaagtggaaaagtcatattgcaaaagggcatgtaagatagaatggagtgttgcagtcgtctttggaaacaatcgaccgtataggacatcttcaaattacaaaataagctacttgccctagaatgtgccctctttccccttctgttacaagcacatgacccagctgtgattaggcagatatggaccataccctagggcatggaatagcaaaaagttgaaagaaacctgtacttggataatcatgcaaagctgagttgctcatcccatgactgttaggtaaagacaaaaaactttcttccatctccgtttctacccgttccctttcaccctcaccccttgtatctttgatgttccctgaactggccaggcactctccagccttagtccttttaattgttctgtccacctgaaacattctttccacaaatatctacagagctcgcttcttcacttcatgcaagggtttatttaaatatcacccacttaataaagtatttttgaccacactttttaaaataaaaatccatgactaatgaagactgacacacatttagtcctttgaacaatatctagataaaaatgtctgtggagtgaaaagaataaatgctgactttgctgttcactggttttcttcaggaaagtctcattatttctcagactacttcatcagaaaatggagataacaatggctttcttttacggtcattgtgaaacttagatggccccgtgtttgagaagtcctccttatgaggtcgccctcatgattgctcttcacttgagttcaggctcccgctctttgtcactcccctttgtggagacagacagactttctggagctgactaaccttgactaacctctcactacccaacccacatctggctacaggggaaagaacattgtcacaggaactaggctggttgtaccatccccacaagagtgtattcagattcttcttgagaagagtctagaattgcaccagaactctgatccccagcccaaaagcttgcatcaatgtggtatttttataaacatgtacatagtgaaatgactaccataatcaagctaattagcatatccatcacctcacatatttaccttccttttttattgtatgagaactcttaagatctattctcttagcaaattccaagtatacaatacagtattattaacaatagtcaccatgctgtacattagatctccaggacttatttctcttgcataacagaaattggactctttactcaacgtctcccaatttcccctacccccaacccctggcaaacattactctatgctctgctacctggatattttgtctctctacgtacattttagattgcacaaaataatttgctgttgtaatgaatggcattgcactggatccacaaatcaagttaggaagacatcttgacaacattgagtctctctatccatgtatatggaatagctctccatgtatttagttctttgatttctttcatcagctttatagctttcctcatatagatcttatacaaatttggtagatgcatacctatgtttttaatttctaggggtgctaatgtaaatgatattctgtttttaatttcaaattccacttgtttattgctgatgtataggaaagtgattgatttttggatattagctgtgctcttatttttatttccctcattttccttgttttgaatttactttgttcttctttcttatttcttgagtaggaacttaagagtattgacttgaggacacaaatgatgctgaatagccaaaacaatatttagcaaaaagaacgaagctggaggcattatactccctgatttcagaacatgttataaagtgatattaattaaaaccacataggtactcctataaaaacagacacattgaccaatggaacaggatagaaagcccagaaataaacccagccacttgatttttgacaaaggttcctagaacacacagtggggaaagaacagctttctcaataaatgctgtgggaaaaactgagtatctgtatgtagaagaatgaaatgagatccttatatcataccatatacaaaaattaactctaaattgatgaaagacttaaatataagacttgaaactgtaaaactattacatgaaaacagagaaaatgatccaagatattggtttgatcagcaatttttttggatataaccctgaaagcatagggaacaaaagcaaaaataaacaaatgggatgacatcaagattaactatcttaattatattatttgatgaatagaagtcattaatttatagaagttcaatttaataaactttaaaaatatttggtgtctttttggtcctatttaagaaatctttgcctatctcaaggtcatggaagatattttgtacttttttgttatagaatttgtattgtttttactgtctaagcttccacattgtggcctatgatccatcctgaataaatgttgctaaaaattaaactttgacttagcttactataaatgatatttatatttatgtattacataatttatttacatattctcatatgtaatacatattattttactataaacactataattaaggcagaatagatagtttagatacatattcatgaagatgccacttccattcaacggacaaaaggatagtcttttcaataaaatttactaggtcagttagatatctgtagatgtggtgggtaattttgtctttaaacttggctgggccacagtgcccagatatttggtcaaatattattctgaatgtttctgtcaagattttttcatttggataagaacaatacataaatcagtggacttagggtatgcacattaccctccatagtgtggatgggccttctccaatcagttgaaagacttaatagagcaaagactggccgggcacggtggcttacgcctgtaatcccagcactttgggaggctgaggtgggcagatcatgaggtcaggagatagagaccatcctggctaacacggtgaaaccccatctctactaaaaatacaaaaaattagccgggcgtagtggcaggcacctgtagtcccagctactcaggaggctgaggcagaagaatggtgtgaacctgggaggtggagcttgcagtgagctgagatgccactgcactccagcctgggcgacagagcaagactctgtctcaaaaaataataataataataatagagcaaagactgacacttcctgagcaaggaggaattctgctagtagactgcctttggagtcaaactgcaactcttccctgggtctcgagcctgctggcctaacctgtagattttggattaaccaagcccttacaattgtgtaagccaattttaaaaaataaatctcttgatatagataggtagatagatagatagaaggacagatagacattctgcttttctgctggttctcttttcctggagaaccctgactaatacaattcggaaaaacacgtatcttgacctgcacttcaccatgcacaaaaattaatttaaaatgaatcatagtatcctgctcatttttaattcttcagataaaaatttacctactatatctttagaataaacttttaataaaagttaattaaaattaagttttaattttatttttatgtttttttctctcccttgtgaaacagtagtacacttgaaaacaggagaattttttttaatgttaccaacgcagttcctggtaacaaatttttagaggctactatgtgtcaggctctgtgataagcattttaagcactttacttccataagtcctcggaataatcataccctcttatgtaagtattattatgaccaccaaatcacagataagaaaacaagcattagagagaaattaagtccaactgattctaaatgcaggacgcttgtacactaggtctccctacatggctcctcaataaataaattcattaagaaataagaaggggctgagcgcagtggctcaagcctgtaatcccagcactttgggaggcctaggcaggcagatcacgaggtcaggagatcgagaccatccagactaacatggtgaaaccccatctctactaaaaacacaaaaaaattagccgggagtggtggcgggcacctgtagtcccagctactcgggaggctgaggcaggagaatggcatgaacccaggaggcagagcttgcagtgagccgagatcgcgccactgcactccaggctgggcgatagagcaagactccgtctcaaaaaaaaaaaaagaaagaagatgggcttaaagtttcataaaatatcagtcatatgagaataaggaaaaggaaaaaagaatgtaaatgaaagataaagacagagaacaagaagaaaacacagcggagaatcagaaataaagaagaatgttgaaagaagagaatatattactatatttatttattgaatatattgattaggctctgttctaggtggcgggataaagatagatgtattatctatgtaaataatatataaataataaatatatattacataatttataaacaagataaattatctatttatagtccaatcatgaagatggcacattaatacctgacaataacaggtagaaatagagccagtgaagatgagacagaaagcatcataaggatcgggaaacacaaggacaacattgaatgggctggttttggagttttaactctgcctcaagaagttatggtacttgcctaagcaaagaggtggaagtcttacagaaaaggaaaatatgagcggacatagctgagtgttggaagaaaagatgagggttgagctaagttgagctgccagggtagagagtagggcagaagttaatttccaacaaggtgctcagaaggatctgatcatggaaagtctgggttttatagatttcatccttttaacagaggagcagctaaagcagacctttcctttgggacgattgtcaggacggaggacacagggtcagttagagaagggtaacagaagtgacgaatgaccatggaagcttatgggtggtttaggcataaggtaaccagggcctgagaccagagaaattccagcagcaagagaaataagagaaaatagaaatgggaagtataggaaaaggaaacattttaaagctcttattccatctctgggcgagcttatacgtatacggtctagagttttttctcttgttgatggtgaaagggaataaacagcatgaaactcaccctggaggctaagatagtttgactcagagttccccccaccgcttgacctttcatgaccctgggtacacactaactctgaagttagtgggcaaggtgggcaggggctcatggactccataaaatccatctgactgttagctctgtctttcaccaggtgggggggccaggggctgtggcttaacctcattgtgcctcagccaattcttctgcatgtaaaatgaggatattcactatgtggccattgtgagatgatccatgaaaacctgtgtagcactgagcacagtgttctcagtaaatgctgagccctaatacccaatatacccacagctccatgcatgtgctccttagcaagcatacgcagacagcttggcttatctgcttgtgtcacattataaaagttggcttcctggttatttctacagtgcagcccataataccgatttccttaagagcaaaaaaaaaaaatgccttatttctttcctcaaaaatgagaattgaccttttaaaacttttcctcaaatgacaggactggtgctgtaaatgcttatgaagactggtccctttgcatgtacgggcttatcttcctgaagatatgaagctgtggctagctgctttcttctgtttcctaacgaccacagaatgcacaaagtagaggtgcaagtggaagctgcaaagagctctacaacctctgtcaaggtgcttgtccttgcccaagctattactgttcttggtggagattattccccgctgatctaaaatatgctctaaggccaaggtgggcggatcacacgaggtcaggagttcgagaccagcctggccaatataatgaaaccacatttctgctaaaaaatacaaaaattagctgggtgtggtgatgcacacctgtaatcccagctactcgggaggttgaggcaggagaatcgcttgagcccaggaagtggaggttgcagtgaaccaagatcacaccaccgcacttcagcctgggtgacagagagagactccatctcaaaaaaaagtaataataaatacatcataaaatatgctctaatgttggagccaaaggtcagcactgtcactacacaaagcctcactttgagtagagatgcctgctgctgctatttcttgggacatgagcattctttaactgagtttaaaagttcttgaattataaatggatagaaatacagcttcacagaggtatgctcataaaggagtcttcacacttgaagatacagtggacacatacacacacacacacacacacacgtttagagaagttcccttaatcaatctgacagcatgtagttataaaaaacacaaattggccgggcgcggtggctcacgcctgtaatcccagcagtttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggctgagcttgcagtgagccgagatcccgccactgcactccagcctgggcgacagagcgagactccgtctcaaaaaaaaaaaaaaaaaaaaccacacaaattttatgaggtgacggtacagcttctgcttccctatatactatacctctggagaacgaagagcactgaatactatatttttactttctatgtttggaactacacttattatcatgccattactcaataaacatgcatcacaatgtccccataccaccatgaatgggcacaaataaccccatcctattgtggtggggttaattttttaggacagcaggtgctgtccactgttaagagcgtcagtttgcctgattttttcaagtttattctccaagagcctttcactcaggttgggtctgcaaagcaccagcaagtccaacaactcaaccaaatgtctacagctgcgggtggcagataagtatagcagctaacccaaagcaaataaaaacaactcctaggggaaataagagggatgctgggagggctttttatttgagtgccactgtggtcttactgatttgagtgcccacttgtttcagaatttagggtgtgggagtgaccaaggatcacagtgactagaggaaactagaaacaaaatagacattgttcactttggttgctaaatttaatatgtccctattgcactttttgttttgggaaatttttccaacattaagaaaagcccttttaaagaagagtgttaaaacattggttacatgagaaccaaggaggattcaccttacaaggtgaaattatgtgttttattcaattttcacactactataaagaaatacctgagactgtgtaatttataaatgaaagaggagttttttgttttgttttgttttcactcaaaattcttcagtttttacaaaactaacagggtggagtggggaggctggggggcaggcagcctcaggagtagggctggtgagaggcgctatgcttctgtctccacctgagactggctccctgctgtgttgctcttccactccgccttcatctctgtgtcagtgggatggtctcctgagcaagcctctgccttggccttgttctcctcctcagccagcctctcaaacattttggcatagaacttcttccgggcaagctgcctgtggatccgctgctgacacacagccagctgggccctggcggctttgttgttggggtagagctgcaggaccttctggaagtcagcccatgccagttcaaagtcattcaccgccaggtgggcctctccccggcggaaggggcccttctcgttgttgctgtccagttctagggccttgttacagctttcaatggcagcagagaaggcctgtagtttcagctgacacatggccaggtcgaggtgagaggccagtggaggggcctgtgccttctgtgcttcctcattggaaaaactagacatattccagccaggacacaatcttcttacactgtagtaaagcttgcttgtatttgccttccttgaagtacacactgccctgctctttcactacggtgttctgttccagcttctcttctgaaatcatctcccaagattccttggccttttcaaaactcttgagatataattcatatttcagctcggcatttggtgggatttggaacttttccttcccaacactgccaaaagcatagctgggcttgaggtacacagtggaatgttctcctttctccaagtgctgaatggccctctcgagatcataaggcagatccaggttctccccctcactaacctcaaagcggagcgcccgttggtcaaagagctggtccttgcagcacccttccagcgcaacctccaccatagcgccctcatcgggcttgacatagccttcaccgcgagtccctattctgcggatgattcccccatctttcaaacacaagcgtggcgttatggggagatcgttggaggactgtctgctgaactctaggcatattctggtttgcaggtgatgtggcccacctcccccaccttcatggttgctacggcaatgtcccaagccttgatgacctccccttttcccaggtcaaaggagaatttgtccttgcgatccacactggagtcaaactttgtgccctctaacagccagccagtgtagtggacaaagactaggtccccagtcatgggcatctctgtacctgtgccctctgtcttgatgactttcagcactccttcatcctgtttggggctgacatccacttccttcttgggcagcggcaccggctgcgccgcactctcggtcgccttcatctccttggctgtcatctctgcgtggcgcgaaatttttccgggagatggcgcaggcgcgagtgcactctgggccgcaggcgggggcgctacctgcagggcatgcgggaggacggacactaccgcgctgactgctgaccgcgcggaggctggagcacctctcaggaaacaggtttaattgacacagttccacgtggctggggagggctcaggaaacttacaatcatggcggaaggcaaaggagaagcaagtatcttcttcacgaggcagcaggaaaaagaaaacaggcgaaacttcctcttacaaaaaaaccatcagatctcacgagaactcactcaccagcaccagcacagcatcggggaaactgtccctgtgatccaaccaccccccaccaggtccctccttggacgtgtggggattacaattcgagatgagatttggatggggacagagagccaaaccatatcagtatgtctattcagaaaaatgtttatacatatatatatatatatatatatatatatttttttttttttttttttttttttttttttttttttcagagtgttactctgtcacccaggctggagtgcagtatcgcgatcttggctcactgcaacctctgtctcccgggttcaagcgattctcctgcctcagcctccggagtggctgggattacaggcgcccaccagcacgcccagctacatatatatatatgtatttttagtagagacagggtttcaccatgttggccaggctggtcttgaactcctaacctcaggtgatccaccagctgttgtaagccactgagcctggccagaaaaatgttatttatattctaatggtaccaacttcaatacgctttatcactctgaaccacagttttttaatttaataaggaaaattgggtagaaaaatatattaaaatatatattaatctatcaaatactacacaaagacaagtctttaaatgggttgggcaatatgctgaagttgaacaccagtaaaacgttgagtaacccctccatagaattcccatagaaatctcttccttaccataaacctaagatcattgctctctctcactaccacagggatgtgattttagcatttgtatccaatttacgggtagcctaagccatcagtgagatatttggcattctgtatctaagcctgttccctcaccaccacacttcttcatttctcttggttctattctatctgtagaagacactgaaaagtgacgagatgtgctgttgaaaatctgtttcaaaatcatacactcattgctcactaaatattagctcttcagtcccctggaggtacctgggatcagtctctcccgcctctctatgtagaagagggaggggtactctgacttttgggcggttgtatattctctcggttttcaaaaatgtctactaattaaatgccattggacatgtgctcctacttcctgtgggggatgagacacagtgtgacacaaaagacaaaatgtcctttctgtatgttattatgtcgctttgttcatattctgtgaccctacacatttataatgtcacctttacctttcattatgttcatacgttcacactatattctgagacccctcatttcattgttgatttgtcgatttctgaacaaacagcagttttaattattttaacttcagacttttcagtacgaaaagtcatatctgatttttatcttgcttgaaaatgcttcttactcgtattctcctcaggatgaaattcccttcatcccgatactcagtaacctcattaattccatccattccacctgactttctccccatctattagctcctgctgtattcgtttctcatcttatcaagcttaggaagaatatcgtccattatttaccatttcctctcttgtatcattagtcaaaactgtgtttctccaagtgtggtccatgaaactattgcctccgaattaccaggggtacttgctaaaatgcatattcctaggccccattcaatctggaatgaatgaagcttgaaatctgcaaatggaatatgcgcctctgaagtacattatcgtttgatagctgcttccctagcctctctgcccatcgcatggcatcactctcacaaaccctgactcaggatgaacctgcctttctgccttcttatggcctttaactaactggggtgagtggtgtgactgaacgagcatcaccacaatccacttcaacaggcttcaaacaccactgataatcctgatacagaagtcagcatctgccacacattctccctatcagcagtgacccaagtgttcagtcccagccagtacctcacttcacttatattgagtttcctttaatgggccactgttgctcttttctcccaatacttgtgagtctgagacaccctagtttatcaaacatgttctaaatggcactgaagctcaaagagaaatggtctggatgccacttcccttctgcaaatggctcttttatatctctataaatttgcaaatgaaaaatagatacttctagaagcaggagcaacctcacttatcagaccattgataagacaaacatagttacaaccatcccctgaaccatgcattgggcacttgccttatacctgttatcatgagagggactgtccaagtggttcatgccagagaaaaagagagttttcccaatgtaaatgaaattaacctctaaggatttaatacttctagtaatttcaaaatgattttaaaaaattaaacttcttctttgctccttaaatttccctgtacctcacactataaatgagtgcacaagaaagattaaaaaaaagatgacactaaaatttttgctgttatttgggaatgatgaaaataggagtgaatttttaattattatttttacaaagtaacatttattaattttgtaattagaaggaagaaagataatatttatttcacaaatatgctccaacttgaaaatgctttgaagatgaggggtgaggtcagcagcccgctgtgtcagtaaggtacttcagccttgggtcctgtacacacttacaacagcaggaaaatctggtgctttgggaagaggtgtccacaggggctaaggcacaaaataagagggctgcatatggactgtgtgaagtaataaattcctgaaggcctgcttattctatgtatttaatatttaaaattacccattcaagcatggaaaagacaatttagggcctttataaccaaagaggataagaatgatctgttctccttaatggaaccccagagactagaatttaactatttcctggctccattccacttctaccaccccaatttgagtctagaactcaaagtacaattcatcctagattctatgcacacgtacaaatcatcacatttgttttacctagaagtgtaatggtaacttagtgttgcaagaaaagccctatgtctattcagaaaatgttatttatattctaatggtaccaacccctcccttgacttgtctctgtaaccattctggtaaaaaggaggaattaaggtaaataggagggattacgggttgaagatggacaatcactcaaaacttgaaaagaaaaagtcactccactgcctaaagcacttcaatgattgcccattgcattcagaataaaattcaagttgcttatcctgacctttgaagccctaaacccttccattcctctgtctttctcagtttatcttatgccagtctctctctgtgccatcctcatggacatgaatagtcttctttggtctgaagattattcttggttgctttatatactgcttaataataagaagaaatttgccccctttgaattccaaataagataaaagaagtggctggatgttatcacaagtacaacatttctgtttgggaagtatggaatacttctcagccataaaaaagaatgaaattatattttttgcagcaatatggatggaactggaggccattatcttaagtgatataactcagaaacagaaattcaaagactgcatgttctcacttataagtgagagataagtaatatgtacccatggacatgaaaagtggaatagacattgaagactcattggagattttggagactccagtagacactggaagggtgagagggaagtgagggatgagaaattacctgaaaggtacactgtacactatttgggtgatgggtacactaaatgctgaggtttcaccagcacacaatatatccatgtaacaaaactgcacttgtacccccaagtctatttttaaaagtgattaaaatccatatgttctccccaaccagcatttgccagaacaatggcccccatgcgcctgcagggacttgaccaactattagggcaaaggcctgctacttatctacttccatggtgaagaaaaccacaacagctttggtgagcaagaatgtggaatcctttgaggaacctctgctagggtccaacctgcagaccctgacccagcgatggatgaatgaagtacactgacacacagatattctgctttgccagtccagctgagtgtctgagccacctacagactcccaggagagtactgtaaacagttgcaactcctcgatcagtcagtgagacttgcatttatttagtaaagattaactgacaaaggtcataggaaaacaccattagagggaaattgacattggggacttcctgggtagaaagaaattaagcacccagggtacatcaaaggttagtcttaggaaaacaagttagttagataaactactctacattattttgtatttgtgccttaagctctctagctcctgcaaagagactctggctgccttcagccagacaatcagaagctatgcaaactctcaggctttccaagagagtttgtggctattactataactatcattaatatttttccaactggcctgattgaacccccacaaaactcaacttcagcagagagctggaagcagggtaaggaactgcagttgccattgcaattcattgagaataaagagaaactaaagggacttcaaactcatttgaataaccttagtctctttgtgtcatagaatattcttaaaatacttccaagataaatcatgatatgactcacagagggaaaagatctgtcattttggagaccttaaaatacttgatttttaaaaatgtgtgcattttacttacccttgtgatataaagtactaagatttcacaggggttgtgtaaaaatgtgcattttatattcagagaaaaggctgcaagcacagagatgtcacttcagggattcagtttctagttgttatcttattgtcaatcctttcagcttggtcatctctatatccccacacaccagctcattaaagtaagatatttgctatgttttatgtataatatagagaaaagcagacatcactttccataactcatatgtttctgaaatgatatgtactctttgtaagactcagaaatcatccctctctgcttacctaattaaaaagtagaaaatcaaatatttctggtatgatgctgcttttcaccattttaaatatgactagaaaaggcttgcatgcaccttactgtagaaataaaggtagactacccacatgagaacaggtgattaattcaaagtttgggagtgggaaagctttagagtgagcaaaaaacgggagggaaagcgtgggggaaggcttcaagtatgctctgattgcatgtagttggcaaggggaagttggaagtaggttaactagaagcagagtatcttatgtggttggtttggggaacatattttgctttatttggttggttctaagttggaaacaaggcaaaatagggaagctaacagtcattaatgatatcctgaccatttgggaccaatcactgccaatgatgtggtttggcttcctggactggtggcttcagagattgtgaatcagaattctattgtcatatcatctgaccactattcatttgaatatttatcctctcagccccccattatggtcattctcttacgagagattgaccaattcaggggcagctagaaacccacatcttcaccactgtgatattgccgagtggtctccattacaaactatattgtgaggtcttgactttttgttgttgtgtcagcactgagatgtgaggccagttggactccctgggtccagtggggacctggggaactttcctgtcttacaagaggattgtataaagcaccaatcagcactctgtaaaatgcaccaatcagcactctgtaaaatgcaccaatcagcagattctaaaagtagccaattgcccggaggattgaaaaaagggcattctgataggacaggaacagaatatgggaggggccaataagggaataaaagctggccaccccagccaccagtggcaaccagctcccccttccatgctgtggaagctttgctcttcacaataaaccttgctagtgctcagtttgggtctgtgccatctttaagagctgtaacagtcacagcgaaggtctgtggctttattcatgaagtcagcgagaccatgaacccaccagtaggaaccaactctggacacagtatggcaatgatctctggtgagaacagctgcccagtagaatgtaagacttggcagagtttgtgatggacctgcatcatggcaggtatgaccaaagtgttgcacgttttgtagttccgtgtgcagggtggaatggtgcccagcggctttttctcccctgttgcttggcgagtgagagggagggttacagtgttacaggattcgttcagtgccgcttcaccagctggaaatctctgtggctgcactgacttctgttccggcccttgctcaggcctgccaggttgctctgcccacttggcccagcaggctgcgcttggctcacattactggcccagatcctgtggtcagtgtggctgcgtgctcagctcgtaactggactgggcatgctgcaattggtttccatattgggcgctggtatctagatgaaggggaggtggtggcgccggaatacttggagatgacagcaactacaaagccccaaagggtgttacagcttttgcttggggagtcctgaggtctgagccccccggaaatgttacagttctctctggttcctgctgcctgcagctcagtgaacaggggtgcattacatctcctttgttactgccacccgcagcttcgggagttcccacaaccaacaagaataaggtgtgtggacagcagagagtcagaaaggcagagaagaattttattgagcgacagaaaagctctcaacacaagaggggacctgaagtgggtagacttctgtgtgaaagggggcctgaaagccggcagccatctgtgtagctgagtataggatttttaagggctcagaatggaggagtgcatgctgattgggccgggggtggtcttggaaaaagcaccatttattggttaaaaggcatagaggatgttctcactccggttgtggactctacctagaactggcagttgggttttcaggggtcaggctgtctttggcttaaaggtcgggtttcaaaaacaaaaataatcactagtccctataaaatgttacagaagcagaaattctaattttccaccccagaccaagagaacatataggccacagaccatgaagatctgccttagaatggcaattatcttttttccataaggaaatgtgagatgtagagcctgttttactttgcctgtttcgttgattcaaatatagtgagaagtattagcaataacacagagctaccatgagtagccaagaagaaatctagagaaatatggttattattacttgtaataatagagacaatgtcattaataacttctgccagagttattggtgatgaaactattggtgatggttttcttacagtttttttctatttgtacaattctcactctgattattcacacagtgagtcagtaactcccccaggtagactgcctgaataatcaagggtggccgcatttggaagctccagtctgaggtggaatttccagacttccgtttggaaactggggttgacccactgatattttataatggcctatctgaatccttagaaacttctcctttgaagatttacagaagacaataactttaggccaggctcggtggctcacgcttgtaatcccagcactttgggaggctgaggcaggcggatcacgaggtcaggagatggagaacatcctggctaacacagtgaaaccccatctctattaaaaaaaaaaaaaaaaaaaggccaggcgtggcagcgggtgcctgtagtcccagctactcaggaggctgaggcaggagaatggcgtgaacccaggaggtggaacttgtagtgagctgaggtggcaccactgcactccagcatgggcgacagagcaagaatccatctcaaaaaacaaaaaccaaccaaccaaacaaacaaacaaaaacattaactttagttaaggcttttttttggcataaagttctgttagaattttttctttagtttttctattaccttctttctttgtatgggcctcaaccttaaaatagccaactctagaaagtagagtgccttaacttattcattttcatggggtttccagcagagatgatgaatttctttttttccccaaagcatcccaaattcatgtagtactctaaaagcatacctgctatatgtttactacatggtcttcagctaattgacaagctctagtaagtgtaataaattccattatatgggttgattttacctcagatagaaaatatattctaaagtagagcttaaattagtgataattttcaatatcagttttgaggtatgatccatcaatgaataacattgaatcagagttcacaatgagagccagtctctcatcaatctgagtgaggtacagaaactcccctgacttataaccatcatgaggttcccttcttctggcagggggagaagagtggcagtttaaggaattgcatcagtgaatagtaaagcgagagagagggagtaaaactctcataacaagttgatcagctggttgaaaagtattgcatgctctttgtcagtggttatgtctacactggccagggaatcatgatgtgaggtggggagcctagaaatagtttaaaagaagcatcaacaaatgttgcagtggaagctgttgccttaagacaagggctataagcctttgcagctgggtcaagggtaaggctatggaaaatgatgaatttttgatggtttccatgacattgagttaaaaacaaaaaagcttgtacaagttatccatgcacaattagacaaaatggcatattgtagtcaggggtgcctaattatgaaagagagtgcctaactaccaaaggaagaggctactgaagagccttcttgagttacagaatttatatttgggcccccacaaaagacagtttcttactaaggactcagccaattcataaaaagagattgcaagctcagaaaaatttcacagccattgtctacaatatccagttaaacctagaaatcctctcaattgtcattttgcgaggcatcgaggtgaagtttcgatagtgttctgtctaccaatagaggcaaaataatttcaccctcttaagataacttacaccctaaatactagcctgtcttttgacaaaattataatttatcttttgaaacattatgttctttttctgctatggctgagagcaagtatttacttgctctcaccttctcaccagcttcctcgttctctgaagaaagcagtggagatcatctgatcctgcatatactgcatcaaaactgaatcacaagtgaaatttagaacttttaagtcttgattgaggacttgtggaaagtaagagggggctttagtgagcccctggggtatgactatccgggtatatttgttgtcctctccagatgaaggcaaagtcgttgactgttctggtttggaagcacactgaaaaatgcacagtaaagattcaatatggtcaagcaagtggttttgggcagaattgatgacaggataggtactactaggaagcaaagcaaaacaattttgttgatctttcctgaggtcatgaaaaaagtgtaccagcagaacaagtgtggtgcatgggctattgcagcgtatgagaaagtctttggagataaggtcatcaactacagttttgaagccttcctttgcttctgatttttcaagaaatatcagggaagtttgaccatggtttactaggatacttctgaacttgactaggttctgctccaataatttcccatataaatggatttttttagtttgtagagtgttaggtagagtgttgaggtctttatctggagcgtatgtcaaatatgatgaaggagacaaacatatatccagagacgacatttagaggaaccctcaggagactctgctgtgcatttattatttttctgagacagagtgctgctctgttacccgggctggagtgcagaggtgtgatcttggctcactgcaacctctgcatcccgggttcaggtgatcctcccattttagcctcccaagtagctgggattacaagcatgtgccaccacaccagctaatttttgtatttctttttttttttttttttttttagtagaggcagggtttcaccatgttagccaggctggtcttgaactcctggactcaagtggtccacccacctcagcctcccaaagtgctaggattacaggcgtgagccaccatgcccagctggtgcacttactattataattctatttgaaaattaagttactccccattaaatttgcaagagtgttataatagagcagggagaaatgtttttaagtcaagtacccaaaggttgtagttacagtaggagatagacggaatctgtgggttatttgagatacctgctacttgcttcctatgaggaaaatgttgagcaaaattgccagggtttaatgtagaaagagttagtgcctggctgggcatggtggctcacacctgtaatcccagcactttggggggccaaggcaggcagatcacctgaggtcaggagttctagagcagcctgaccaacatggcaaaaccccatctctactaaaaatacaaaaaaaaaaaaaaaaaaaaaaaaagcagggtatcatggtgcatgcctgtagtcccagttactcaggaggctgaggcaggagaatcacttgaacccaggaagcggttgcagtgaaccgagattgtgccaatgcactgcagcctcagtgacagactaagactccatctcaaaacaaaaaaagaaagaaagaaaagaaagagtagcgcccatattgccaggaattgctgaggttggccacctatatttatggttaattcaccttgaatgttaaattttaaatcaggatattgggtaccttcattgatctaaattaaggggtcttttggtcttatttttactggaaaatcatttttcaggtgtcccttctgttttcaatatctgcaggtgtcctcttctatgggtcgtccactcaactgtttgatctgcagggccgtaaggttattctggatcctgtcttgttattgtcctagggctctgcaaaaatgtcagccaggtgttgaagttcaggtaaagtggctatttcccattctaattttgatctaattattgtctccaatttcaggtttaattccattaacaaagtaggtaaaagagccattattacacttacacttctttaacactcaaatgttgttgaaaggggttttctagtttattctgaaaatctcctataatttcttcttttctttatttacatgattaaattgtggtccattttatttttactagaaatgtttcaagtaaggcttttaggatacattgccctactttttgagcctccttttggccctcaggcttattgtggaaagaaagatgctgtagatctctgtcctggtgaatccaactggcttttgccatcaggatttaatgtctgaggatctacaaacataaatacaagttgatatagttcaggtaaccctgagttgtgtacaactaaaagaatttagaattctgaactcctttgggaaatgcttagtcatagcttttaattcagctcgtgttcaaggtttaaattctactgctgcttgcatatttgggtcattgaagagatggaactttagaggtaaatgacattccgggatcttaggagagtcactgggagaaggtagggggtctggaagaagagggaggagtcaatgaggtgtgaaaggaggatgggggatgaggaagagttgcagagctgaagtcaactggaggagaagccgggggaagatttgctgggcaaatgagttagtttgttgttaagtttgtcatactgttcattagctctggccaaaaaatattttagcggagtaatgtctgaatcagaatttcatttgaaaacttgtgtaccaatcaaaaactgctgcccattgcccctgagaaatattctctcttttctaaggtgtttttcaaatgaacaattttgttcaagtccagtgttctccagattagccactgaaggcctaaattatccttggtatagagatgggtgcaagtgctaggatcgtagcaagggtacatataagaaatgggagattttcctggaggaaaaaaaggaaaagaggatgtacactcagaaaattccatgggagctggcaatggtcagttgaaagtaatatttgtgcactttatgtcttaggcccccaacctgatagttggcaacctccaaatgcagacttgacaacttgtgcccacaggcaaatggaaaaccagaatattccctctgcatcaaatccaacctctcagggccaaaaaaaaaaaaaaaaaagatgaagaaccttatcccattttattggtgactgacaggaaagtttaggaaagtttgtccagatggatgctggtttggtaagaattgcagctcatcagttgtggagcaagctgagacactcttagaggagcaatgcctgtgttctgcactgattctccttctgataacagacaacactttagacatatctcataaaacagaagcacaaaagagaacaaaaaggaatgaaaagaaatggcagtatttttccaaaggtgccaaacaaatgggaattggtagcaaaagctgagtaccaagctgagagtcaataaccaaggatctcaatacaaagagaacagagttgaagcccaattctgttctctcacagacactgtgtcaacacagacttgacaggcctcaagaagcaaggcacaagaggcctccatagataccgcacttgatcagggtccaaagtccatggtgatgagcagttaagaatgtgtctcagtggagcttctaggaaaattacagaaatacagaccaggcatggtggctcatgcctataaacccagcactttgggaggctgaggcaggtggatcacctgaggtcaggagttcgagaccagcctggccaacatggtgaaaccctgtctctgcaaaaaatacaaaaattagacaggtgtggtagcacatgcctgtagtttcagctacttgggaggctgaggcaggagaatctcttgaacctgggaggcagagcccagatctgcagtgagcccagatcgtgctgctgcactccagtctgggcgacagggcaagattcagtctcaaaaaaataaaaaaataaaaaaaaacagaaaattacagaaataaaggagacaacttaatgagaacagaagctatttatttcttgcttgctagagaaagggaggcagtcgctatcatttatgtttgacagagactcaggctgggagaatgggaaagctttatagtgaaaaggggcaaggctttggggtaggtggctatgggcatggagaggcgcaggtaggctaaagagaagcaaggcatctgatgggataggtttggagagagtatttggctttctttaattattactaaactagaagcaggggcaatcttagagaagttggcagtcattgaccaacctctgattgttttcggcaaattgctactgaatttgtggcttgcattcctgaactggctgctgcagagattgtggtttgccttcccaagctggttgctgcagtggttgtgggtcagagttccattgtcgtacgtggtttggccactgtctgttttaatattcagtctctattactaaaaggtatacaaatggctaggcttctcacttcagttcttcatgtacaagctccttttagaggtttctgcactaaactattgtaaaaaaaaaaaaaagaaaaaaaaaaggccaactccatttatccaatgtcaaccttgacgttaagaatgatgaatgtggcagctgtttccttctgttattgatctttttactgacccttcccattgtgctttgtcaatgactgagtatcttccctggaccgctcttatctgaagtcgtcctcatctctcagggattttcagcaccatctgtcagccaggcgctgtgactctgtcgtcagtgaccatttttattgacttttgtctctttctggcctttccatggtgccttggccttaaatgtcctactaatttgctcagtggtgattacagtgctggttttgagagcaccctgttgttttttcttatctaggagaatattttttctctctttatctggaaatattaccttgctggctatgctgacttaggtcattgacatcagatcagtgttctaaatctgatcctagtattcccatctacaatcttcccacacaagccaagggaagagacacacttgattaaaaccttgcactctctttcctatttggctattttttctcctcttggagaaagagtttccccaaaatactatatgaagtgttattttgtaagcctacttaacttagttttatatactgtgcacaaactttacatataatttgaataggctcagttttttgttagtttttttagtttttcaccaaattttatatgacagactatttaagctaaataatttgttgtagttagaagactgttttctcatttacataccaaaatctaccaaaatgaatttattacacttaagaatttttgttaattaccattatcacttctgtaaaataaaataaatctaagaattttatgagcaaagctttttcaagtctactatttagtttagcaattattctaaatatcaatctcaaaattagagtaagggatttccccttttaggaaaagatatcaataattatatagtaaaaatttaaaattaagatacagacatttattctgtgttggatcccaaatatctcattagagaatgatcttctctcattgtctgctattttctaaaatacaggaagatataaagtataaatctgattttttttctaccagaagttaaagaacatagaatatatttggtatgattaactgggagtttgtatttcctctgccatctagaaatattattattttaaatatctgcaatattatttattttaaaagtttttagtttgaaaagacatttctgaaagccccaaatctgtgagcatttgctactacaaaatttttaattgtaagcaattgagagagaaaagtcctcgaatttggccaagcgtggtggctcacgcctgtaatcccagcactttgggaggctgaggtgagcggatcacgaggtcaggagatcgagaccatcctggctaacaggatgaaactccgtctctactgaaaatacaaaaaattggccaggtgtggtggcgggcacctgtagtcccactactcaggaggctgaggcaggagaatggcgtgagcccggtaggcagagcttgcagtgagccgagattgcgccactgcactccagcctaggtgacagagcgagactccatctcaaaaatgaataaataaataaataaaagtccttgaatttatgcaaatgacatagcaatcacttcaactcttaaataatctaaccatcatgagataagagaatggatttttttctactcgtttgtatcttgtctttttgaaagagactacttgttaataatatgcttctgacaaaacaaaaactaaggaaagtgtatgatacaggcctgagtctctctcctcaagttcactttttaaaaataaagtataatcagggataatgtagcctctacttgtaaaggaaggctggctttatgtattaatgaaataggcagcttcttacacgatgtgatttcaacagagccaggaagtatgtcttatctttaaataactccctaaataactccttctaacaccaatatctgaaatgttgtgactgatttctttctgtcctgccctgaagttctttcctgactgcaaagaacagcacattttgaatgtttcaaactgtcatacatgttctctccagaagagtggagtgatgccccaccagacattctaagtcacaggataacatgacatattccatgattgtcagttttaccatgtggcaagtagttaaaaagacgaagtttatagttccaagaacacaaactatgttatggaataggactaaacacaaggagtaaagtagtaccttgtttttgctttaggttactcaccttgctatcagtaattgtattcactgaagtattgaggaacacattaacgttggtttcagatttgttgactttaagttccacatctgaagtatgttggcactttgaccttgcataattcaaagtcatgtctctgcaccactgtttcattctatataaagtgattgacaataatagttatcccacccaagttggacttccatttctgtcaattggccaaactgggtttcctaaaagccttgtagcgctacaaaatatcagaaaattatatcaagtctacttttaagtaaatgtgaagctctcaaggaagccctgatggcaatccagaaatagataaaagcagtacaggagctacagttgcctggggaacagaaactgacctgggttacccagagtttggggtattaacaactactcaggggaaagtaaaagtaggccttggacacataaaatgttgggaaggctgagccagacttcttgcatatagctgagtcacaataggctaagaacatgaatttaggaaggaaagcaaaaaaatctacaagcagtatgaaaaaaaaatctccaacaccttgatacattttaatgaaacatcagatgacaaagaaatatacaaattcttgaaagtgccagagacaaatcagagattcctagagtgaaaagaatgtccaccttttaatggggttatttgtttttttcttgtaaatttgtttaagttccctgtagatgctggatattagacctttgtcagatggatagattgcaaaatttttctcccattctgtagcttgtcttttcactctgatgacagtttcttttgctatagagaagctctctagtttaattagatcccatttgtcaatttttgcttttgttgcattgcttttggcatcttcatcatgaaatatttgcccatacctgtgtcctgaatggtattgactaggttttcttttaggttttttataattttgggttatacatttaagtctttaacccatcttgtgttgatttttctatatggtccattttctgcatatggctagccagagttctcccagcaccatttattaaatagggaatcctttccccattgcttgtttttgtcaggtttcttgaagattagatggctataagtctgtggtcttagttctgggttatcgtttctgttcccttggtctatgtgtctgttcttgtaccagtaccatgctgttttggttactgtagccttatagtatagtttgaagtcaggtagtgtgatgcctccagctttgtgttttttgctcaggattgttgtggctatttgggctttttttttttttttttggttctatgtgaattttaaaatagtttttttaattctctgaagaatatcaatgatagtttaatgggaatagcattgaatctataaattgttttaggcagtacggccattttcatgatattgtttttttcttatccatgggcatgaaatgttttttcattttttggtgtcatctctgatttctttgagcaatgttttgtagctctctttgtagaggtctttcagctccctgattagctgtattcttatgtattttattcttttgtggcaattgtgaatgggagttcatttgtgatttggctcttggcttgcctgttgttggtgtataggaatgctagtaatttttgcacatcgattttgtatcctgagacttcgctgaagttgcttgtcagcttaagaagcttttgggctgagatgatggcattttctagatataggattatgtcatctgcaaacagaaatagtttcccaagaagggagttaaaacaggaacatctcacagccattacagaaattgaagtatttatgtatctcaattaaaaccaaaccatcataaacgtatttctttgaaaaatatcttttttttttttttttgagatggagtctggctctgtcgcccaggctggagtgtagtggcgccatcttggcttactgcaagctccgcctcccaggttcacgccattctcctgcctcagcctcccaaatagctgggactacaggcgcccaccaccacacccggctaattttttgtatttttagtagagccagggtttcaccgtattagccaggatggtctcaatctcctgacctcgtgatctgcccacctcggcctcctgaagtgctgggattacaggcatgagccactgtgcctggccgaaagatatcatttttaatgcctgctaaaatattccactgtatggatataccaaaacttactccttgacttagtaattaaatgtatttatattctgtcttgagtttgcctcccatgtttcaaatatactagtcttctcagttacattgccaaggccattatttatattttgatggtattctcagcaccagctgctgtgatcattgaaatgtattcttgaccttagatgctcattgcacacttgacagattgagaactgactagaggtgcttgttagtatctgtatctcagtggctggggacagctggactcagcttatgtgactcatgcaaagtcagatgatcagtcatagagggaacttggaacttaaaagtgtaaactggaacttacgcttttaaaaattattctatctcacatagtgagaaatctttatgactctttagtctacaaaagggatcagtgaacagtttctgtaaggtgacagatgatatggtatagagtagttccccttatccatggtttcactttctgtggtttcagttaaatgtggtcaactgtggtctggaaatattaaatggaaaattctagaaataatgtatacgtttagattatacgctgttttgagtagtgtccctcctagaacacgaatcaccactttgtctagcatatccatgccttatacgctacctgcccattagtcacttagtagccttctgagttatcagattgactgttgaggtatcacaatgctgtgtttaaggagccctcattttacttaataatggcaccaaagcacaagaatagtgatgctggcttattgttagaattgttctatgttattagtagctattgttgttaatctcttaccgtgcctaatttataaactttattataagtatatatgtaaaggaaacacaatatgtatagtgtcctgtactactgaagatttcaggtgtccactgaggatcttggaaggaatcccctgtggataagggtgcaccactgtaaatatgttcagctttgagggcaacatagtctctgtcacaactgctctacctgcaacagcgccagacaaatctggctaaactttaatccaacaaagttatgagttggtctgagccctcaggctgaaggtcatgtaaactgagcatgcccagatgaaccaagtatgcaaccacaaggggaacagaagtgcccagaccaaggagaagaccaaggagcagggactgacttaagaagcagacgcagtatggaaggatccaggatccaatcaaattgagctctggcatcagcccattgtgggatcgaatcagatcatgactcctggcatcatctcattgcagaattcaatcagatcacacctcattaccctatgcttataaaacccgacccaaacgccagctgggggtgatatattggagcacttcctcctgtctccttaccagtccacttgcaatgaagcttttttttcctcaaaagccagtgccatggtcttggcctccatgtacattaggcagcaagcccattgtttgctcagtaacaccctacctttgcatccctttgtatcgtgaaaacagccacagagacaatgtaaatgacttttatctcatttaaatgaattgtcaacctcagctaaattactacttatcatataaacagaaaatgtaaataaactgattatttctttccatccatgtttttactgtcttcatgtatagcatgtataggattttgaagttaactgtttctgaaaacttacttgcaaatttttcaacactgcaaaaattgcttaaaataatgaagccaagaaaattaagccaggttaaaaacataaaagaagaaaaggaaggagggcaggcaggtaggcatttgttaaaagcttctttccctcagtatactattatttgcgattcagctgtcttgttgtgtttatcagtaagttgattcttggccaggcacagtggcttcacgcctataatcccagcactttgggaggcccaggcacgtggatcacttgaggtcagcagtttgagaccatcctggccaacatggtgaaaccccgtctctactaaaaatacaaaaattagctgggtgtggtggcgggcacctgtaatcccagctactccggaggctgaggcaggagaatcgcttgaacctcgaggcagagcttgcagtgagccgagatctcaccacttgcacttcagcttgggcaacagagtgagactccttcaaaaaaaaagttgattctttttattgtgagtaccgttccattgtataccatttgttagcccattctcttattgatggacagctgggatgtttagatgttagaaataaagatgccttgaactatcataagttttcatgtgaacctatgttttttaattctcttgggattagaactgctgggacagaggatcagtgaaaccttaattttttttttttatttttgagatggagtctctgtcacccaggctgtagtgcagtggcgcgatctcggctcactgcaagctccgcctcccgggttcacgccattctcctgcctcagcctcccgagtagctggaactacaggcacccgcaaccacacccagctaattttttgtatttttagtagagatggggtttcactgtgttagccaggatggtctcgatctcctgacctcgtgatccatccacctcggcctcccaaagtgctgggattacaggcatgagccaccacccccggccgaaaccttaattttatgaaatgttttttatgttccagaccttaactgatgagcttttaaaactaacttctaaatttgaaatgtacatttaattatggaatacgctttaatgtaatcttttgggataatcacctaatattttgccttgagatttttaatataaataacaataaaataaataactaatagtaaatgaataccttctcaatcttcctaaccttggaatatggggacaggatgtgaaaatatcttagagttttgagatcttttcatggttccctcaaggcttttaaaaagagtatttaattgctggcagtggtagctgacgcctgtaatcccagcattttgggagaccgaggcgggtggatcacctgaggtcagaagttcaagaccagcctggtcaacatggtgaaaccccgtctctactaaatatacaaaaattagccaggcgtggtggcgggcgcctgcaatcccagctactcaggaggctgaggcagaattgcttgaacccgggaggcacaggttgcagtgagctgagattgtgccattgcattccagcctgggcaacaagagcgaaatttcattccaaaaaaagagtatttaattgtgttgattttaatgattactgaaattttggctgtttttttgaaactatttcttgtttcctttctctttcccttgtaaataagctgtaagagaaaactgctcaatcacaaaacgtaacagaaggctttcatgtcagtgtccaataggaatgaattttttatggtgacaaggtagggttataatccagatctctggtaggcacatccataaggtgcaaggtgtgtagaaaatagcatcagtttttttggctgggtgcggtggctcacgcctgtaatcctaggattttgggaggctgaggaccgtggatcacctgaggtgtcaagagttcgagaccagcagatatggtgttcttgttctcaaagccgaggtgggtggatcacctgaggccaggagttcaagaccagcttggccaacatggcaaaaccccgtctctactaaaaatacaaaaattagccaggcgtggtggcaggtgcctgtagtcccagttactcaggaggctgaggcaggagaatggcgtgaacccgggaggcggagcttgcagtgagctgagatcctaccactgcacttcagcctgggcacagagtgagattccatctcaaaaaaaaaaaaaaaaaaaagagtctaggatccagagaagtaaactgtattaatgatgtggtcatatccatgccagagcttatttggaaatgcacagaattgattccaagatgttttaataatgcaatctggggtttgcatctcaaagtaatgatccatcaaggatggtctttagagctattttctaactcacatgcttagtggagactcacatcaaaatgccctgttaataggaatcagtagctggtaaactgaagcctaattcaattggtgtcatttccctgcaaattcgtactccatttctgtgctatcaactgaagaccacccacccaaagctattagtatacaatatgatgtgtaacagagctccatgacttctctgtggaataaattatttcactgtagtttttaaaaatatttttcatgtttatactcagagtaaatgagcaatgttacaactattcttctctgtaaattgtcacaccttaagttccttaggatggctcaactctttcacacttccagcatgggaaataattgtttaataaaaataaaacataacaatggattcatgatccaaagaaggcaaaatagaagattttttgttttctatttctcttgactcctcagctaattgtaccaccactaaacctttctttatctcccccacctcacagggttaatctctaatgcttctcaacattttatacctatgtggaaactaccatttaactaaattttgtttgatgtggaaaaaaaatcattctttcaatatttgataattttggatagctaagcacttttgttagatttttattttcttcaagagaaataagatagacgcagtggaaaggattacttctcagtccccaggggttgaatactcacccgaggactcagtgcatttgattcctgatactcatttaagtccccttttcatgcttacttactagtacttcttaaatttgtctccttccaggtgaaataattcaaaacaactcaagaatggaactactgattcattaataaagaacagaaaataaacaagggcaaaacttgagaacataaatacacaaaaacacaaagactcacttaatttttatctcagataaaaaaggaaagtagtttgctgaatttgcctttctactaagaagtctttgctttcacttggttgggagggtacttaacatgaagaagcaggaattcctggaaaacaggccccttctaccctaatgtgttttctgtggggttgttcagttattgtccctaagcagaggtaactgggaaatagccttgggctgtaattttcccattttaccttaagcaatatcataactagcaatgtgtgacacccaggaggtttgttttctagataacactctctttacaatataagggctctttgagagagttaatataataaatcctcagagtaaagtctaggatactctttagaaattaaatattacttgaaacatatgaaagccattcagcaggtgacagagctatttacaaatagattaaacatctttcaagtaaattattataacattcattaatgttgttagtgtttatgcactaaaacatagcccaaaataacatattttatcctcatattgtaacacaatttatgttacacttgaacaaaaatccctcaatgtgcagctgattttaaatccatcatcagttctactagtcaaaagtggagaatctttttgcatttgtacctctggtagccaacgtaatgtatcttctctccatgtttctttatccattcattaatgtgctgttttcacattgcttcgttttgaaattgtccatggcccagctgaaccaagcagaaagatttcccaggctggttgcattgtatttcaccttctgttgtcaattcttttggtctcctaagaataaaatcctttggtctcataagaataaaatgagttttgttttcctttgagcatgtagaatatttttggttattgttcaaaagtgaagccacaaatcagaaaatgtttttcttcttcgtttatttgttcctctagcaatgtatatttcatatatgtgagtgcttaggtctaaatttcaggtctacattcggcacagcatcttcatggacagctaatgagattgcagatggtaaagcagaacatgtgtggtcatgggataaactactccaaatatcttattaaacccttaacactcccctctctcacaggcttcctttgcataaacattttaaattacatttttataaagacatagataaatgaatacctccactgtaatttttcttaaaatttagcatgattatctcctttgaagaatagaatggtcctttaatcaaccaattaaaattgtataacccaccggaagaattcatatattatgtttaataattagtcataaaccatatgtctgggactatttaatattgactttagctccatgtatattatttccatctacttttttattttagtaggttaatagtatgagtatgaatatattaatttctaagtggaaagagatgtactttattaagctttggattgtcaaggagaggaatggttaaatatgactaaggtccatttatatttaactctgctatttttttctggaattgacagtataggtgaatgcatgctcgtattgtactttctcctttgaaataatgaagaagccagacaaaaggattattgctcacagaagagaatagaaaaaaggaagagaaccagggaaagaaggacccaatccactttctctaaaattattcatgtttgagacaatgactgatttcatgagtatcttcttacctctctatgtctttttctggcatattttaaggttgatttttgaactgcctttataaatgttttctaaggtttcaatgaaggtaaatatgcctttgcaaactatttctcaggctatgaaccatgagtgtgtgggtcagtgagtggcaatgatgacatgccacacttgtgaagaaataaatgatgaaaggttaaatgctttttgccttagatcaggaagaagaggttgttcacttgtttagaatgaactctctgagattctttatctgctcagcttgtagccattgtttctgcagccaccagagacccagacagaagcgcagcagcaggagatccacctgcatgggtcagattgcagatgtggcttcagtgacatgaccacagtgtgaaagttccctggggggcacacagcatgcttagaaaacacacacacacacggaggtcattgcctttattgggtccagggcattatataaacagggagctttaaattgatgggcttaaagcaagcaggcactagtactaggaagtcacattgtgactgaaaagtgtttaaatggtcgtttagaggaagcagcaggaaagctgggagcccatcctgctaggagacagagatgcctccaggtttttatttctggtcaccacctggagccatttgggggtatagtacaggaaactgcatcaagggtgactgaaccctgcttctggtttgagaaagttaaacacatatttaaaaatggatgctaaggcaacataaaactttaagcgctcactgcagcacatttacctcttttatttaccattgtattggaggttctagccaagataagataattaaacgaagaataaagtaaaggcattcagattggaaaggaagaggtaaaattagctctacttgcagatgacattacctttatatagaaaaccccaacaatgccactaaaaaaaattattggaactaataaacaagttcagcctgaccgcaaggtacaagatcaatatacaaaaattgtaggggcccggccctgcacagcgccctggggaagctggtttgaaagctctggagcgaccccagtgccgggtaaaggacaagatttgcccagacggaagggaacttggggagaggtggccgtgagagtgtgggatgaaaatgtttcgggcagagcggtcggaactcacctgaggaaagcatggggggaggagtcattaatatgaatgagtggcagggacagggcgtccttgcagcgccctcggtgttggaagggaagaccgtgcagcgcgatggggatcagggcggcgggccgcagccggggtggggttgggcgccggtcagggtgccttgaagcagattctgtcctcaggagctgcagttcttcctcctccgccctcaccggcgggcgaccttaggcagggagtgaaatgcaacgggagccctggagggagggtgaagccgcgcgtgcaggaggaacctccgattggcgagttcaggttccccagctgcggaggtggggaaccctgtgtggcagcctgctgagcggctgcgtgctccgcggttggaggggggaagctctagcccccctcctctttttcagccgagaaaccgctagttacccccttatgcaaccaagactgtaataaccctgtcacctttcacggccctccgggtctgcgcctatcctctgaagattcactcatccaccccgaggcctgttttcctcacctgttgtccctctggcagaacttaggccccttggagaccagccagcatctatctgcccgctgttcccacccaccacactccctccgcagttctatcccagctccttaaatggttggagtccaaacctcagaccatgacagcacacgggcctggactccggtatggccctggacaagttccttaatctctctgagcctcagctttcttccacgtgaagcagcggtaacattgttattaggagcctccgggccccagcacaccgacatacatacaagtggatatccatcctgcctgtgaggagtcgtctttactttgggttgtttcttgtccacagaggtccacactttattttcctggaggcaccagcagagtcactgatgcacccctgcatccagcatgtttaagggagacagtctggggagggcaggaagagcctagagggtcccctagtgattagggctgtgatggggatgttactggaaaagggtccctatccagaccccaagagagggttcttggacctcctgcaagaaggaatttggggcaagtccataaagtgaaagcaagcttattaagaaagtaaaggaatgaaagaatgtttactccataggcagagcagcggcatgagctgctcgactgactatacttacagttatttcttgatcatatgctaaacaaagggtggattattcatgagttttccgggaaaggggtgggcaattcctgcaactgagggttcctaccctttttagaccctatagggtaacttcctgatgttgccatggcatttgtagactgtcctggcactggcaggagtgtcatttagcatggaaatgcattataattagcatataatgagcagtgaggatgaccagaggtcactttcgtcaccatcttggttttggctggctcctttactgcatcctgttttatcagcaaggtctttgtgacctgtatcttgtgcggactttctatctcatcctgacttagaatgcctaagctagtgggaatgcagcctcgcaggtctcagccttattttacccagcccctattcaagatggaatcgctctcgttcgatcacctctgacaggggcagtgtacattcacatcttggcctttgctgcctcatccttccagatctttcagatgcttgccctctggcattctaggataggaagactgcttccaaagtgacgcaggaattttctcggacacttttccaactgcagacttctggctggtgatgcccctgcccatgcctagctctgccccaggcaggaggtgccctgcccacttgggcttgcactctggtggggatcctgcagccactgagactgcatgctcagccccagtaggagggtgtgtgtgatcaagtgagtgcctcatcttgccagcaactccaagtgctggcacaagagcaggctccctttggggcctgcagctggatcaggcctgtcggaagtgactccaggggtgaactctggcatgcagatgaagggaacttggtggtgcccaaacaggaaagcactcgactctgaagccccagaggggatgttacagccatgctaacagctcttttagtcccacggtcagcagcctgacaaacaggggcatgttaacaatgaatggggggtgtgttaacaactctgtcagtcctgttgcctgctcctaccagaggctccctggctggcctggccctgcactgcctctcatggcaaggggctgccactgggcacagatagtgggggaggggtggagggctatggtgttactgccttcttcataccctttgctgacaatggaagggtgaaaagggtggagaagagttttatgaagcaatgaaacagctctcagcggagaggggatgcgagggtggtccctgacctgaagtccggtggtctctctcccagcgtggctgggtccggggcttttatgggctcagaagtggggactgcatgctgattggtttacgagtatgcaaaaaaggctaaaacaaaggaaccattcaaaggtggcatgacagtgtagaaaaccacttagggaagggtagatatatgtaaagtaagtgaagggtggggatcagtcagaggaaagtgcaccaacaggaagagatgttctcagctcggtccatggatttatacaagacttgtagcttagctttcgggctttaaactgcctttggtttgaaagttggatttcattggggacatgccactatctgcctaggggcttgtctgactcctgccactattaaaagtactaaatcagtgcatctagcctgagggctgcccctagtctacccagcagaggtttttgttttgttttgtttttcttttgttttaattaaaattttaattaaaagggactaatatagagggtttttaaaaaattaccatatgtgttgagtatttatgctatgccaagcacttcgcatatattttctcatttaatcctctaaatagcgaggttgattgccttatctccaatctatagatgagaaagctgagactcagagaaattaagaaacccacatgaggtcatgttgtatgtaagttagtttttgctgcatcataaaccacccgtttatgatttcaaacaggtaatacttgtttctcaataacgggaagggggctggatggctaaggggcctcatattttagggacaggaggagctcatcgtcagctgggtaatgggaatgcgaccacaagtctcattatccaggagagcttgaacataggggttgagtttcaaaagcagcacaagggcagcaacacaagaacttcccatgtctcacttatgtcatatttgctattctcccattggccaaagcaggtcacaagggcatggccagccagtatggaaggggacaaccaaaggggtggacacagggagtgacaattgctgccattttccccaacaaagaatctaccatccatagcttctaagtgtacaactggaaatcaaaactaagtttgtcttacttgaaagttcaaacctgtcttggagctactgcctggggtctaggaatccaaaacattccacacattgcctaagtcaacaacctgttgcgcacacacaccagcaactgttttgcaaaagtatgtggatctggttgtcattgataaaatgcaaattaatttagatgtattattcaattcatagtataattttgttgtattttcaaatcaacagatatttacgtcatttcaaagcagctcttcacaaattattcattagttacaaaaggaagtcacttcacagtggaaaaatctggcaggcgccaccttaatcaagtaaccaaaatgaacatcatcagtaataggacaaattgcaatcgtgtgcctcctgatagtctagcaagaagaacacagcatcacttctatgatgctcctgccaataatacataattggaatctaatcctaaagcaacaaattcaaattaaggaaaattctacaaaataattggcctgtaatagaagtgtaaagtcatgaaagttaaggaaagactgaagaactgttccagactgaagatgaaagagacgtgagaaataagtgcagtggtgattctgaactggatcctgacttggcaaaacttgaataggtctgttggctggatggtagaaatctattaatgttgatttcctgattttgctagctatattacaatttcattgcattcagtccttgtttatagaagacatacagtatgtaggggttataaggagtcaggtcaggaactttcaaatcatttagcaaaacaaaagttctttgtactttaattccaagacttctataaatttgagaatattttaaaaatactttaaaaaactcctttaaagtctctcaacatgctgtcctattaataatagatttctaaatttgtttttatttttatcaaagttttgtgtgcccatagtttgaagtattaaatctttttttatttattaaaacattttttaatgtccattcagaggtaatgaagtgttagtttttttttttttttgagacagagtctcgctgtgtcacccaggctggaatgcaatggtgcaatcttggctcactgcatcctctgtctcccaggttcaagcaattctcctgcctcagccacccgagtaggtgtgattacaggcgcccgccatcgtgcccagctaatttttgtatttttagtagagacagggtttcaccatgttagtcaagctggtctcgaacccctgtcctcaggtgatccacccgctttggcctcccaaagtgctgggattacaggtgtgagccactttgcctggcttgaagtgttagttttgtctttttttttttttttaaagaaaagtagttcccttatctccactttccccctttcctgcacctcagaggcaactgctttcagctgattactttgacaggtatgaccttatttccacataattgcttatgtcattatttttttctttttgagctagggtcttgctctgttgcccaggagtgcagtggcgcacttgtagctcactacaaccttgaactcctgggctcaaatgatcctctggcctcagtctcctgataagctgggactacaggtacatgctaccatgcctggctaatttgttttcgcagagacaaggtctcactatgttgcttgggctgacctctaacttctaggctcaagtgatcctcctgcctcggcctcccaaagtgttggaatacaggcgttgaaatcaagtttagcctaaagttgcctccttatatatttaagtttggcctaaaagtttgtctgtatattgtgacaagtggaggtgtaaacagactacacttgtgccaatcactgagttttggccaatcaaatgtagccaactgttcaaaccatgttcagataaggcaaatgccaagctgtagccaaatccagctgtttctgtacctcacttccattttctgtccataaaccttccaccgcgtgactgcgctggagtgtccaagcctactctgcctgggaaggctgcccgattcttgaactgtttgttgttcaattaaactcctttaaattaaaaaaaaattgtatttctgtactctagcaatgaacacttcaaattaagacaattccattgataatcgcatcaaaaaataaaatgcttagaaattaattattcaaaaagagcaaaagttgtaccctaaaactacaaaacatacttgaaagaaggttaaaaaaaaaaaggagtaaataaatgacaagacaccaatgttcagagattgggagacagacattattaagatggctttccaaattgatatacagtcaccacatctctatagaaatcccaacagccttttctgtggaaattgacaagcccatccaaaaattcatgtggaaatgcaagggactcctgatagtcaaagtaatctcaaaagtgaagagcaaatttggagtatgcacacttctctatttcaaaatttactacaaagctatggtaataattacagacttgtactggcataaggatagacatatagaccaatgggatacagctaagagtctagaaatcaatgtttacatgaatagtcagttgattttcaaccagaatgccaaggctgttcaatggaaataatagtcttttcaacaaatggtgctgggaaaactggatgtcacatgctaactactgaaactggaccctttcttcatattttatacaaaaagttacctcaaaaatatatcatatactaaaatttaatagataaaattataaaactcttagaagagagcataggggaaaaaatcttcttgactttagctttcttagatatgacaccaaaagcacaagcaacaacagaagaaaatagataagttggacttcctataatttatacatatatgaatatatcacattgtatcccataaatacacacagtcattatttgtcaattgaattttttttttaagtaaaaaaaaattttttttgaggtggagtcttactctgtcacccgggctagagttcagtggtgtgatcttggctctctgcaatctctgcctcctgggttcaagaattttcatgcctcagcctccccagtagctgagattacaggtatgcaccaccacaccaggttaatttttgtatttttagtagagatggggtttcgccatgttggccaggtttgtctcggacccctgacatcaggtgatctgcccaccttggcctccctaaatgctaggattacaggcctgagccactgcgcctggccagaatttttgtagttccaaagatgctaccaagaaactgaaaagacgacacacagaatgagagaaaatatttgcaaatcatatatctgataagagattatatccagaatgtataaagaacacttaccactcaataataaaaatacaaataacccagtttaaaaatgagcaatgaatgtgactaaagatttttccaaagattggcctgtgtgctcataggaagatgatcaacattatttgtcattagaacaatataaatcaaaaccacaaaaaaggctgggcatggtggctcacacctgtaatcccagcactttgggaggctgacatgggcagatcacttgaggtcaggagttcgagacaagtctggccaacatggcaaaaccctgtctctactaaaaatactagctaaaaattagctagctaaaaaattagctagctaaaaattagctaggcatggtggtaggtgcctgtaatcccaggtacttgggaggctgaattttacttttagatggataaaatgtacattatataaactatatgtcaatacagctatgtatttttttaaagtacaaactatttttttaaatacaaaaacattacatagagtgaactctatggcatagctgccatactgaaggaattatactgtgtttaaaaacctgattaaaaattaagtttttaaaaaatggggtcattaaattttattttaaggttttaacagttctttacccaagccaaacattttatctacagttgcccaaggaaatgcagtaagcgggttacttaatttcctccctgtggcaatccttggctctcgcccttcttaacactttattaatgcaagtcagcaactgctagttttacatcttatctttcatcaatgtttaagagatagcaagtctagggctcattatgatctgctaatatagttcttaacaagacacttagcttccatagttatttgccagtgaagcaagaaagtggtaccacttcatcattattctgattttattggagagagtgaatgtgtgagtttactgagggaagcagcccaaggaagtgggatggtacaaattctacaacagagatcacccatagacaaggagtggacccatgaaacttaaagatgtagcgatttagggagtgactttacatcctaggattaatgtctttgggggtttatgattaatatttagttccttgttgccatgtaacagaagatgtaaatgggttgctgtggtgagtcatattataattttggtttttttttttgagacggagtcttgctctgtctcctatgctaaagtgcagcagcgtgattttggctcactgcaacctccgcctccctggttcaagtgattctcttgcctcagcctcccgagtagctgggactacaggtgcccaccaccacgcccggctaatttttgtatttttggtagagacggggtttcaccatattggccaggctggtcttgaactcctgacctcgtgatctgcccccctcggcctcccaaagtgctgggattacaggcgtgagccaccacgcccagccaattttggttttaattagaaactagataggatgcataccaaatatatattatgacgtgtccccaccccctgccaaatagacacatatacattgtctccttatcttttctccaattacagtatctatttcactcacaacttttatgcaaaatcatgaaataaaaataattttaaaaattattaatcttcaaaatcttaaaaattattaatcaaatggataaatttgatatatgtgatattatttgtctttggtaattttgtaaagacttttaaactgtttttaacattcaaaaggaaagacacatctctctcttttaatgtagagggtcagtcttggttatttacagcatacatgggaggccttatttgattctccaatccctggaaaaatagagttgaatgctcatttgatcctattccacatgctactggtttccctcctgttcaccctgctccagccttgaggatgttcttgccgaaatatcaccatccaaagctctttctctatcaggcttttgcatttgctgttcccttttccacatcttctcaaggctggatcttctttagttttcagcaaaatgtgaactctgtgaagaggcctccctgaccactcaattagccactgccccatgactagttttttttttttttaactttcttaaagtgctttaacttcctcaagcccttattattattctttgagtgcattttgattatttgtttcttgtttatcatctagaagtagatgacaacttcatgacaacaggaacataatcctcatgagggcaggcattttactagtattgttcacgattactttcccactcccatgtcaaattctgtgctgtaataggcattcaataaataatggaatgaatgaatgacagacaaatgtcacacatcatgccacctgatgttataacatccaatgttgataaccgaacagaagcaaaattaaaggccatgagatattggaatggtcacactgattaaaggctttgtgggctgcacctcattgcacacatttatcaatgactgaattaaggtgatatttagcagtttgatattacctatgaaaacaaaccaaatggatgtagcatgctttctttttttgaaacatatttaataattgatttcaatcattttcaatctgaagttttaatatacttttaacaacagatttcatagtttggttttgtttttcttgtttgtttagtgactcgtttacttgagcattaatattaagccagttctttgtgtagttatatatagaagtagccatcaactcccaagcaccaactccaggccagttcgaatacggaggactcacttgaattcctgcatctcaatgatggtacagcctggagcccttctgtcctccataccaataggcagttacagctgatttggttgtttggcagcgaatctctgtcctgctgccttcaagctgccatttcatttcttcagtatggagacaggaaatgtggcttaccatcagcaacaagctagtagtaatcatcctcatggaagacacaaaaacgtttgtcaagagggtccaaagtttgtagctggtgagaatgtacaggaagagagggaggaagagagggagggagggtggaagagacagagggagggtggaagaaagagaggaaggaaggaaagagggagggagtaatagagtaagagagagagcctgagaaagatagaggtggactccacacataccagcaaaacaaactcatgaggtagaactttttagcatttaagctttgaccagcatccagatgattttcttttcttttctttttttttttgagacacagtcttgggccatctcccaggctggagtgcaatggcgcgatcttggctcactgcaaccctctcctcctgggttcaagcgattctcctgcctcagcctcccaagtagctgggattacaggtgcctgccaccaagcctggccaccacgccatcacttctccatgttggccagcctggtctcgaactcctgacctcaggttatccacccgcctcagccttccaaagtgctgggattacaggcgtgagccaccgcacccggcctcaaatgattttgaaatgtactcagcaatgcaaaactatcgtcccgaattcttaatttggtgcattttgcttaaaggaatgtaagttgacaaatggtatgtgtaatttcccctgtggtttccctcttcagagtctgtgctccctgcattgaataatgagatgtaagtttaggaaatgcctccatggtgttcattatactttgtgtattttccctgagacaggaaacagaggactgtctgtcaaagaaagcaatttttataaattcacagccaatggggaatattcctttcattttttttagctaaatctgtgatttaacaagtgtagagaagtgtttgtcagcaaggagattgaaatcattatgtctttctctacctgttgataatgatattgcaagtgggaagtcgcaaatatattggcatcaatagcaacatggcaagcagatgaagctccaaaactcgtcacccactttgaagccaaataaaaagcccatttttctttctagttattaatgatgtgaaactacagactgtaactgcaaatgatcattggcaagggcaacataaaagttataaatttaggctttgaaaacaaataaaacttgaagcaatcctctgtattttattcctaaattaaagatttcctctttttttttgagtgaaagaacttatacttaagcatggaaatgagaactaaatcatttgctgaaacaattgtctgagagttacttaattcaaaaccactcttgtcatatgaaataaagcagaacttgattagcatgtaataaaaggctattactttaacagacagtaaatatattgctgattcctgaagtctctggccccattttctcttcagaaaactatttcaactgatagcattctctcctttcattgaagtcctatagtaattaaaatcagttatttaattatatactgccttgatatacagagttcaaagtttgtaggactattgctaatcatctaaatcaggagtctggtaaactatggcccaaataattaaacttggccataaccatttttttcttttttttttttttttttttgagatggagtcttgctctgttgcccaggctggagtgcagtggccctatctgggctcactgcaagctccgcctcccaggttcacaccattctcctgcctcagcctccagagtagctgggactacaggcgcccgccaccacgcctggctaattcttttgtatttttagcagagacagtgtttcaccgtgttagccaggatggtctcgaactcctgacctcgtgatccacccacctcggcctcccaaagtgctgggattacaggcgtgagccactgctcccggcccttggccatacccatttttttacattttatctatgattgctttcctgtgattgagttgaacagctgtgcagagacattacagcctctagaacaaaagtaaatttactatctggccctttgttgaaatagaccttaagattgtcacgggaaaaaattgaatctcctactcagaggatattgtttcacaagtgtggtccctaaaatggagcagggaaccctcttggggcctgcaccccctccattccaccaccctgcacccccatgcatggaaataaaggaaaatattgagttccttcaagggaaattccaggcacctagctagccctgagaagcaagcaacttgataagcaagaaagtaatcacagcttaaaacaacagccaaggaagttctagccataagatatttgaaactaaaggtaacattttaacatatgtccctgagttgtttttcagaaacccagactccctaccgagcagatccgctggcgggtagaacacagataagggggagctgaggactgaactccgaactccgtttgtccttggttctaaatttattcttgagggacctggaggaagccgtgcccacgtgccagagctaataatcttttctgctgaccccaaatgtttaaacaaactcttttttcatcaattgcaaaacagtctttgaatatacctatgaccggtaatctcctacctcaaactatcccacctttttaggccaaaccaatgtatcagttcacaatgttgttgtaacttctgttttcctgaaatttacccctgcctttaaaacccttacttgtggccgggcgcagtggctgacgcctgtaatcccagcactttgggaggccgaggtgggcggatcacgaggtcagaagatcgagaccaacctggctaacacggtgaaacctcgtctctactaaaaatacaaaaaattagctgggcgtggtggcgggcgcctgtagtcccagctactcgggaggctgaggcaggagaatggcgtgaacccgggaggcggagcttacagtgagcggagatcgcgccactgcagtccagcctgggtggcagagccagactccatctcaaacaaaacaaaacaaaacaaactcttactcgcaagccatcaggaggtcaggtgtaaagcaggagctgctatattctccttgcttggcaccctgcaaataaacacctcttttctcctgctgcaaaccttggtgtgggtgtttggcctgactgcgctgggcaggcagacccagcttaggagtgaaaacatcccagaccagcagcatgagcaccacctagcaagttgtcagaaatataaattccaggctgggcagagtggctcacacctgtaatcctagcactttgggaggccgaagctggtggatcacctgaggtcaggaagtcaagaccagcctggccaacatgatgaaaccccgtctctgctaaaaaaatacaaaaattagccagggtggtggcgggctcctgtaatcccagctacaagggagactgaggcaggagaatcgcttcaacccaggaggtggaggttgcagtgagcccctgagatcatgccattgtgctgcagcttcagcaacaagagcgaaattttgtctcaaaaaaaaaagaaaaaaagaaaaaaagaagactgaccatgttgagaggtgaagccagctgggcttctggggcaggtggggacttggagaacttttatgtctagctaaaggattgcaaatgcaccaatcagcactctgtaaaatggaccaatcagcaggatgtgggcagggccaaataagggactaaaagctggccacccaagctagcgtcagcaactcgcttgggtttccatccaggctgtggaagctttgttcttttgctccccacagtaaatcttgctgctgctcactctttgggtccgccccacctttaagagctgtagcactcgccacgaaagtctgtggcttcactcctgaagtccgtgagatcacgagcccatgggaaggaggaaactcctgacacaccatctttaagggctgtaacactcacggcgaggttggctgcttcattcttgaagtcagcaagacgaagaacccaccacaaggaataaattccggacacaatgttacctgtcatttaaaatgtagccacttctcctccctttcctggtctctccttgttcctattggaagttacctctaacacttccatttgtttaatatcataaagttgcaagaaacgtacagagagagaaaaaggttctaacttttcttaagataatatgggtgtatatatacgcaaatatatatataatgcttgtataaattaacatttattatcttctatgatatgataaggcatatcaccaagtaatctggaatatcaaaatatcagcatcagctctctctgtttcaatacgtataaactaggtagttcactaggaactttgaatacattagctctgaccttttcaacagttctatggaaaaaaaatagttatctccttttaacagaggaagaaaattgatttttcagggtatttccactcttacctcagtttcctcatatgtaatgtgggattgactcagtcatctgcttgaaagaagacaggcaaatctggtcctctgaagagggaaaggggagatgagcgaaaatgaacagaggaagccaaaaaaaaaaaaaaaaaaaacacacacacaagcacacaccaaaaataaggaggagacccattttaacaggcatataacaagtcagttttatctctttatttttttattttgtatttttttttgagactgagtctcaccctgtcacccaggctggagtgcagtggcacaatcttggctcactgcaacctccacctcccgggcttaaaggattcccttgactcagcctccagagtagctgggattacaagtgtgcaccaccatgcctggctaagtttttgtatttttagtagaaagggagtttcaccaagttggcaaggcttgtcttgaactcctgacctcaagtgatctgcctgtgtcggactcccaaattgctgggattatgggcgtgagccagtgtgtctggcagagttttatcttcaaataaaatatttttttaagaaagctgaaagcctcacagaagatatgtccttgagggaaaaatttcaaacccttgacttgcttgtcatttggtagtttttgtaactgagtctcagtgagctacggttttcgtagctctacagacacaaagcaaaagggtggtcataaagctgcctttcagcagacatctgcaggcatggctgggtgtgtgccacacactggccagctcagaacatgtccttgtcactgtgaagcttaatgagatgcacagtctatgacctgtcttaaagcaaagtgaagacataagcaaaacagaagccaccctgatatttcagagtgggatatctgttaagagatgatctcattcagattgatttttaatattaattgaattgcaggcttgccacaatatggtggaatactaacaaaacataaaagccgcagtagccgtggggtgtgacgtcagcaagtgataaaatgagactttctggatctcggcccctcacagaaacatcaatttgaacaaatcttcacacacaaaaatcctttcacaagagctgaggaatccacatgagagatcacagcatgttgagtgtaacatagaaataaaacccaagctctgggaccaccaccccagctctaggccagcccctgcagaccaaggtccaggctggcctccagggcccaaggctccaggcccaccccagaaccaggcttggccccatgaactcatatatatacagcctgagtctgagaaaaaaaggtaatttttcttcacagtgaaaattgcagccaaagcaacatcttgcattggatatatatgtctttctctagggcctggacatgcagaaatgtgtaatattcatagagaattgtctccagcaatgaagaggaatatgtgggaacatttaattttttacaacaaagttacaatctgggaaacacactttagtctgatgcaaactcaatcaatgctagtattggctactcagaataacctacaatttaatttatgtcagtttttataatcatccctgaaaatcagaactcataattacgatgttgtgtataattgcaaatgagaattttagaaatcatttaaaagccaaaaggtgtttatgaaggtaaaaatctcaaatttcaaacaaaaccttgtgatttgagataaaagatctaatagcatcataacagattcatatgcaaatttaatacaaatgcaacaggaatttagctggaagagaagatgctgcattttgaacaactgtgttgagtgactcaaaacatggctcctgtaaggaggaagatctcatgctggaaatgcacgtgatgaatgaataaaatatttttacaaagactatattttctttttgttttgagactgagtttcactcttgttgcccaggctggagtgcagtggtgagatctcgtctcactgcagcctctgcctcccgggttcaagtgattctcctacctcagcctccagagtagctgggattacaggcacccctgaggtcaggagttttttgtttttggttttttgtttttgagacagagtctcattctgtcacccaggctggagtgccctggctcaatctcggctcactacaacctctgcctcctgggttgaagtgactgtcctgccatagcctcctgagtagctgagattacaggtacccgccaccacgaccggctaatttttgtattttcagtagagacagggtttcaccatattggcgaggctggtcttgaactcctgacctcaggtgatccacccgcctcagtctcccaaagtgctgggattataggcgtgagccaccgcgcccaacaaaagactatgctttcaggaatcatttcttttttttttttctgagacagagtctcactgtgtcacccagtctggagtgcagtggcgcaatctcggctcactgcaaggtccacctcccaggttcacaccattctcctgcctcagcctcctgagtagctgggactacaggcacccaccactatgcccggctaatttttttttatttttagtagagacggggtttcaccatgttagccaggatggtctcgatctgacctcgtgatctgcccgccttgtcctctcaaagtgctgggattataggcatgagccactgcgcccagcaaaagactatatactttcaggaatcatttccttttgtttttttttttcctttgagatgaagtctcactgtgtcacccaggctggagtgcagtggtgcgatctgggctcactgcaagctccgcctcccaggttcacgccattctcctgcctcagcctcccaagtagctgggactacaggcgcccaccaccacacccagctaattttttgtatttttagtagaaacggagtttcactgtgttagccaagatggtctcgatctcctgacctcgtgacccacccacctcggcctcccaaagtgctgggattacaggcatgagtcaccacccccggccgaaaccttaattttatgaaatgttttttatgttccagaccttaactgatgagcttttaaaactaacttctaaatttgaaatgtatatttaattatggaatacgctttaatgtaatcttttgggataatcacctaatattttgccttggcattaggcatggagcatttgtctgggtgatcacatggaaggccctgcctcagtttacctccctcattgacctgcttgttgactaaattatcataacttgatcacaattcctttgaagctgcctgaatcaaagccactgatctgcagataaaatcaaaatacacattcagtgttacacacaaagtaacattgccttatatactgtatctacactttattgagaactggaaattccataaagatggagaggcattactgaaggcaagcaagcaaaactctagcatgcagtcagactcatggcaggaattaggcatgatctaccttgtcctcacccttggggcactgcctgcatgtctgtaggcctcggccatgcccagctcctgtggctgcctggaaagtgtgggtttggccagttgctgccatcactactcctcaataggtcctggatctcagaatttgcctggtagtcctgggcccacctgctgatgttcaggataaagggagtggggagaaggggtcattctgcttccttcacgtggaagtgcaggtgttagttttgggggactggacagcaaagagcatggttccttgactcctgggtcatggggtgtctggccacttccacatcgttgccactcactcctagtgatacaccaggcaccagaggctccactcctgaggcacatgccccggctgcctcaacactggcccttccccccaccttggatgagctcctgttgcttcagcatgagcagggctcactctttcactctgcagcaggcctaggctgtgctggcttctgagatgccccagggcacctgctgggaagtggggtgtatgtgcgtgaggcgccagtgttggtccattctcgctgggcagccttattttcccagctttttccttgtgccgccctcagccttttgtctctcatgacttccctttcaggtcacaccactttgctgcttgacccttgagtgttagcaacccttccctgctctgggactcagtttacctttttttggtctagaggggcaggacaggtgatttcttcccagcttgactccagatcaatagcttgccctcccctggtgacagcagagagatctgtgaatcactgcccaccctcaccccactcctgccccttggcatactccccgccccaggtcttcccaggtcacctgcttttaggctccaccacacccctgcaggtcagcctctcccagcagccttcccgtagactccttctcctctctccccgtctctttcctgtagaggctttggagcccatcagcccgaggaccaggactccaccgccctgcacccctcttgcgccaggatggccccaaacttcggcagatgctctggctgtaaaacttggaccagcaccaggtaccccaggcagggccctagttctgctgtcctgctctgaaggccatgttcggtggctggcctagcctgatgggaacatgtacagtcaggaaatctctccacagctccaggcccaggtaaatggttctcaatactctggcccaagggactggtcctttgaggtcaggagcacatctcagcttcaaggaaagctgaaaaacatgcaagactctattgccaggagaatttatttttattttttctttgtgttattattattttttctttatctgcctttttttttctttttttttttttttgagatggagcccaggcgggagtgcaggggcatgatcttggctcactgcaacctccgcctcctgggttcaagtgattctgttgcctcagcctccccaggtagctgagactacaggcgtgtgccaccaagcccaattaattttttttctttttttttttttttagcaaagatggggtttcaccatgttggccaggctggtctcaaactcttgacctcaggtgacctgcctgcctcggcctcccaaagtgctgggattacaggtgtgagccacctcgcctggccctgggccaataattttttaataactcctaccataatatttttgtttgttatttatttgataaatatgatagactaaaaataaattagcaaggccgggtgcggtggctcatgcctgtaatcccagcactttgggaggccaaggcaggcagatcacctgagatcaggagtttgagaccagcttggccaacagggtactaaaaatacaaaaattagccaggcgtggtggcaggtgcctgtaatcccggctacttgggaagctgaggcaggggaatcacttgaacccaggaggcggttctgtttgcaagtatagttgtaactgcaacccaaaatgtcttagaaacttgctatttgaagtattgtcatcacctgggatcttgctagaatctgcatttgacaacattctcaggcaattttaatgatcattaggtttgaaaaacactgccttaaaacaaaggaaagaatggcaggcaagtttcaattctaagcatgctatattgtatgttcttgggcaaattccactaagtctgaattttaaaacagttaactatgggtagtaatgaatgaagtgtcaccttgtaaagctactttgagaaatccaagtgttggcaaaccctttgcaaaaataaagttgctgaacatattctaatacagttatgttgggctcctgttcttatgaggcagagaaaattatgctttaatcagagcttctaagtcacaatcactggaatctattattagcctttaagtcctcattcttgagacagcaccatgtctattcttggttgctgggaaactgattatgctcttcaaatagaaactgcagcagcagatgaactttaagaaaatataatcatgtttgtaagaagaaaaatttaataaaggaagaaatgaagcaaagcaaactcataaactgatctgttttgaaattccatttctgccctcatgatagcattattgacttaataatgaagcaatgttactcattcaaaattgtacagcaatggccaaagactgaatgacctctattttctgaaattgtttcattcacagagttcactcctgatgggaacatccagagacatcttcagagagctttgctttgacccccaccccccaacattttaaggcatggatctggaaataatgtagttggtttacaaaggtaagtcttattttacaattgcatattccacaaaggcatttcactttcaaagctcctccaagacaattacctccagattgagacacaccctgctcctgaattcatgcctgcataccagccattcttaatcaccttcctttttaatccagttggaaaataaaatgtttccttgttctctgaatgtacagtactcagatgtacagtgaaaatgattgatgctgaaaccgcctataaattctttgattccatcagcttttctctttctactggccatttcccattagtgtttaaacttaagactcacacatctcccatcaaataaacccccttcaccctacttcaccgatttcagtattttagcttctcctctccttattgacttcccatttatctttcagtccatcctgctctattttcacttctacaattgcacagaaatgtctctgataaaagttcccagcatacactttggaactgatattacttgatctcacttcagtggtaacaatatgctgctgatggaagtaccacagaactcacaaaaagcttttacttctccaggaaatttcatcatgtctgtctagacccaacaaagccaaaccctgaacaatggccatttcagcctccatttgacccaagccaacttatattgaataaactaatgctttaaaaattataatgagccaggcatggtggctcatgcctgtaatcccagcattttaggaggccgaggcgggtggatctctagaggtcaggagttcaagaccagcctggccaacatggtgaaactgtatctctactaaaaatacaaaaattagctaggcgtggtggcacccacctgtaatcccagctagtagagaggctgaggtgggaaaatcgcttgaacccaggaggcagaggttgcagtgagctgagatcacaccactacactccagtctgagtgacagagcaagactgtctccaaaaataataataaataaataaataaataaataatgaaattcaattgataatgatggaaatcaaccaataaacctacaatactttaagattctttttaaaagaaaacaatatatttttattagaaaaagtaaaggatttattcataataagtaaatcttggtttcagagctcttaatttactgattgactgtgatcagatgccagtgggaatgtgtctgtagcaccattactcacatgagggagtattttaaccctttatatatacatcactaatagtggaaccttgaagaagtccatttctcaatattgatataaattataatttatattgacacactagttttttttcccataagttttatattgaatccaagaaagctttatcagtgtctgacaccaagacatatgctttaaccgtaatgtgtttggaatgtccacagtatattccacggtgtgtgaatctttagctttagaaattagctttgacaagggagaggtcctgaattatccaacaacaaaattgaattattgtataagatgtagcgcccatacctgcagggcatgtgaagctcagtgattggataataagacttttactaatgttatggaacctgggataagcattgcgatagaaccaggaagactgttgtagttcttttatgactcagaaacagtatgatgacttataactaaaactttgttcatacaaggccagcactcttctaatgatgcaatatgcatttgatttatccattgttactattgtccacatgaaaagcaaaaattgacgtaatgtttatgatttaaataatgtaatatataattataatagtaataaaagcatatataataatgtttatattatgagtacgttaggtggggtttccttcttttcccttcaaagctggataaaattgaattatatagccaataacatgccctgtgcaagtctaatactctcttgaaaagtgaaatctctcaggtaagccaaagtttcattgtcacctctggctaaaaatttctacttctagtacgtgtgagattttttttttttttttttttttgagactgagtcttgctctatcacccaggctggagtgcagtggcatgatctcggctcactgcaacctccacctcccgggttcaagcgatttttgtgcttcagcctcccaagtagctgggattatgggcgccagctaccatgcccagctaatttttgtatttttagtagagatggggtttcaccatgttggccaggctggtctcaaactcctgacctcaagtgatctgccccactcccccaccgaaaatgctgggattacaggtgtgagtcaccgtgcctggctgaggattccttttttaaaagtttctacagtgttggaaaataatcaggagagtcaggcaatgtgaaggaactactcagatgtcactggccatctggttaagaagcacagtgatgccatcttgttctaggatggcggcagtagggatggagagaacattgaggagccattctaattcttcccattaccgtgttttatttttgtaatagcaatgatcactttctgcaattatattatttctgtgtatgtttgggtattttttatttatctactttattttcatcttccaccatgaaaatataagatcgaaatggcagagtaaagatgtgctttgtcttgtacactgtatcaacagaactttgacattgctgacagacagttgatgcacattaaatatttgatgaataagtggatgaattaatgaatggaaatagagcaatagggttcgctctagggtagtgtggtatcatgcaagtgggtgtgtaaattgggagagacctgagcatgtttaaatatactggggaattatgtggttggaacaataaattaaatattgagatactcaagcaagatgtcatgggacctaatacaggagataagactatgtgattcgcattaaacactcatgtagcatgtttatacgagatcttcagacttgctatataattattcagcactcaaggtggtgcttaggaaaattgaggaactaaagactcctttgtgttacctgatctgtagaaataatttaaaaccttgtctagttttctttttttttctcctgtcataagcttgttaagagattcctccatagaaactttttttggtaaaataataactgctgttcagtgcatcatttctaacaatgtgatgttagctacaaatatttaggtagcacatcccttcaaaataggcgcttgtggtctgggcgcagtggctcacgcctgcaatcccagcactttgggaggccgaggcaggcggatcacaaggtcaggagatggagaccatcctggctaacacggtgaaaccccgtctctactaaaaatacaaaaaatttgccgggcggggtgtcgggcgggtgcctgtagtcccagctactcgggaggctgaggcaggagaatggcgtgaacccaggaggcggagcttgcagtgaaccgagattgcgccactgcactccagcctgggggacagagcgagactccgactcaacaacaacaacaacaaaaaataggtgcttgcgataacttggagtgctgttcttactgatgctttcactttggtagctcacctctcctacgggaactgtgttctcagacatgtcatggggagtatgtcatcagcacagcttcattggtagagtttactaaaaatacaagttatctgtattttccttataaaggccttcgtatagtgtccaatattttctaaccagatgtacagtgaaaatgattgatgcttaaatacattttcatggtcaatgcaacaaccgttgagcaaaaaaattaacatttattgcagacactaggcagttgtcaaacaatattaatgtcattaaatcaataaatgggcacagaataatggaagcaaggtcatggatgaacagatggcagtgtaatggagtcaatcttttactgatttaaccactctcctcttatttctaatgtcccttccatcacgatgagttctctttgggatgatgtgtatctaactgaagctcctcctcaacagctgctgagaattgagtgttggtggtaattatccatatgatttttaatcagacacttttcacagattcaagtggaatgataactctatgggaaattgataggacagccagagttatgcaaattttggaaaaaaaattaatcaacagctaatacaaatattatgtctaaaggctaacaactggatgatcataataactcaatggctaataaataaactagggaaatccaagccagaattagaagtaaaaattggccattatataattatgaccaagaagttctttcttagttagcaaggggtacagctgtatgtttatttcaaagtaatttttttgtctgcagttacaatgttgaatgaaaggctaaaacaattccttccttagccctttccttttgatgtgaaaaattaactctcagtaccctcagtaactttgaatatgctttttatacccttaaagacaaaaataaagtcatcattttttcattgactgtaactattaatactatattcatgttactgtagctttaactgatgactcatttttagaacatattatcattgatctatggcaaatgcttttaaaattcctcagaagctaatcatttatgttgaaaactcacaaaactgcacataatataatagataaagggagggcataatgaagttttcatttgacttatctgggttttgggatttacccccttacagtatgtgagcctatgaataagtaggtgagcttccagtgctcaaaggtttaatgtacagtgtatttatttttaatctttgtgaattttctatagagcagagctgtttccagtgaattaaaccatatttacttctactacaatattgtagaatgtaattgttacctttactatatatatatattttttcttttttatttatttatttatttatttatttatttattttgaaaatgaatcttgctcggtcacccaggctagagtgcagtggtgtgatctcggctcactgcaaactccacctcccgggttcaagcaattctcctgcctcagcctccaagtagctgagattacaggcacatgcaaccatgccaactaattttgtatttttagtagagatggggtttcgtcatgttggccaggctggtatcaaactcttgacctcaggtgatccacctgcttcggcctcccaaagtgctgggattacagacatgagccacctcacctggccccctttactatatttaaagatgacattgtcatgtgatgtgtatgatgaaaagtatatcattgaactctattctcatatgaaagaacatctgattttctagaagatttatctgccccaggtatattcctgtgagaataatacaaaccaaattaaaatgaagtctgcttttttttttctattccttattgagattgaattcagaattccaaacaggtttgctattcattttcatcttgacaaaatcaaaacctaaatattctatgtgtcacctactgtgatgggaaagataaaactaattatttaattatcaaacatgagtaggtgaattatttttattaatcaacattacataaacgtgttttgagaataaaattttgtatcctcattttttaaccaaagacataaaatataactgacattctgtagcccaatcaatgatatatacacccagattgacctttaagagattaaaaataaatgtacgctgcatggtcaaatggatttggagatacataggctagtagatgaagcactagggctttatgaaacttttttgagggccggtgcggtggctcaagcctataatcccagcagtttgggaggcccaagcgggcagaccacttgaggtgagaagtttgagactagcttggccaacgtggcaaaacatctttactaaaaatacaaaattagccaggcatggtggtgcacacctgtcatcccagctatttgggaggctgaggcatgagaatcacttgaacacgggaagtggagactgcagtcagctgagattgtgccactgcactgcagcctgggcaacagagtgatactccacctcaaaaaaaaaaaaaaaaaaggttttttttttgagttagtgatacacgttaataaattaatccagagatttaaaaaccacttttactttccatgttaaaaaaaatcagcatactttccaactataacctaaaaatctacaaaaaactttccaaattctcagtaaaggaagtattgcaatccacaggagattattgctttgttctaaagacagttgaaacattttcgaatctctgacattttttagatcaccctttgcagggtagggttcacagaacattttttttcctgatcatatgacattgcctacataattttgtgattaaatgactttggaaaatcaggattgagacaagtaaacagtcctatcagaactaaatatgttaatgtatggcgtccccaaggggtgtgatatgcagcattaactcttaaatgtagataatcatgggactttaataagcagatacactttgtgaattactactttaaatattggtagtaatagattgcttaatcgaacttaaatttaaagagatgatgttggacttctagtgaatggaagccaagtatttctatttactagaaaaatgtacatgatctattatccacagtgaactagcaaaccttccatcttgatatttagttttcatattaattgtattatatttcatcagcttacattttttactcactagggcatacttttatttttttcattgcaatagcttattcaatatctgcctattcatatattaagtaataattttttttaacctgcatctcacacagagaaatcatgaggaaatctccactcattctggtcagcatcacagttgcagtatgttgcaggattcctgggagtcgatatgattttttctaatacacacatatgtttctcagcattgggcaaataacctctctggtaactgtgcgcttttctggttcttcccacctaccagctcaacagggtatcatctgaaaaaagaatatgagaaaggcgagtcctatttagcccaactactcaccccctaatgcggttctgcttccgctcagataatgacgtaaaaacagttttttggtgtgtgtgggttttttgttttttttgtttgtttgtttgtttgtttgggacagagtcttgctctgttgcccaggctggagtgcagtggcgtgatctcggctcactgcaagctccgcctcccgggttcacgccattctcctgcctcagcctcctcaagtagctgggactacaggcacccgccaccacgcccggctagctttttgtatttttagtagagacggggtttcaccgtgttcgccaggatggtctcgatctcctgaccttgtgatctgcccgcctcggcctcccaaagtgctgggattacaggtgcgagccactgcacctggccaaaagaaacagttttaagaaaataagtccaaaccctgcaacagaacatttctttaagaatactaaccagcttttttttttttaattaaaaaatatttacggctgggcgcggtggctcatgcctgtaataccagcactttgggaggctgaggcgggcagatcacgaggtcaggagatcaagaccatcctggccaacacggtgaaaccccgtctttactaaaaatacaaaaaaattagccgggcgtggtcgtgggctcatgtagtcccagttcacaggaggctgaggcaggagaatggtgtgaactcgggaggcggagcttacagtgaaccgagatggcgccactgcactccagcctgggggacagagcgagactctgtctcaaaaaaagataaaataaaataaagagactttaatatgttcagtaattacacaaaattaattatcttgagcaggccagttacataatttcttttgtttttgttttctctttctttctttctttcttttttttttttacacagagtcttgctttgtcacccaggctggagtgcggtggcgtgatcttggctcactgcagcctctgccacctgaattcaagagattctcctgtctcagtctcccaagtagctagtactacaggtgcattccaccccacctggctaattttgtgtttttagtagagacgggatgtcaccatgttggccagggtgatcttgaactcttaacctctggtgatcctcctgccttggcctcccaaaatgctgggattacaggcataagccaccacgcccggccctgtaatttcttgaaaacaattttcaaagattgttttcataaaaataagtagcagctatgtagagattgaagctacaatctgtttgagaccatggagtgcctatctaaaaccctaatgtcatgaggagatatgatttctgttattgcatttattagataaaactcccagctgcatattaaacatttagcgtgacatggttttacttctttgcattatcggagctcagagcacagtaccccaaagtatggtgccttggcatgtgtggattgttgcactaaaggagacaggaggggtttagaagcaagtagttctctttggccttctcccatccttctgtctcctgaaacaagccataaaatctagaaaggttatcttttgcctacctcccctgagagctcataagaccctcattccagaggagtcctgccccttacctggagaaaggaatgctacacatgaaaccgtcattgtaaaattataactgaggcagtgaaagagatctgacctaaccaactccatcttgcttctaatttccaagctgtccttcgtcattccttggcgtaggctgaactaactttggaaggaacttagtttataatttatagtttaaaatgaacataatgacagctctttcccaaaacaaatccctttcttgcttagggactagactgcctttgtaggactagtcatgcagctggaggctacgaggttctttccagattgctccaggggataacatcactactgtaaagcctaagaccagctcttgagatattttgcagacactgcacttgatggatcagcagccatcaccccgatcgataaactggctcatctgatattgtggccccactcaggaactgactcagcacaagaggacagctttgactccctatgacctgaccaatccgcacacccaactcactgccccccaccagttcacaaattatccttaaaaactctgatctccaaatgctccaggagactaatttgagcaataataaaacttcagtctcccacacagctggttctgtgtgtattacactttctctgttgcaattcccctgtcttgataaatcagctctgtctaggcagggggcaagatgaacccattgggcggttacacacagagagaccaagaagaatcagaacaaacaggccttgctgggctctgctcagtttattaccattagatcatatccattttgtccagttacccagttacgttgctccacaactattcacttctttcatcagatttaacataaaaatacagtttccccctgggtgtttgggtcttcatttctgaagcctcctgtgtcaaggaaaactttgattaaatacctttgttatgcttttctcttgttaacctgtcttttgttttgggggttttgggctgtaaaccttgtggcgggtgaagaaaagataggacttttctcccctagagtattttaaaagtcttgcggaggcatgtgcttatgtcaaagatgtctggaggcatggcttgactgttcattcaaagacaaagaaacaacactcatggactttcctgcctggaggaaatgtcacccttggccacacagcttctcagagctacgttcacgtccaccagcggcactgataactgactcctcagcactgtccagcgaatgctgcatggaggctcgcaggcaccccagcttagaaaggaggagcagaaggtaaatacctacctagtacacaggaaatcaaagagcaaagcttaagaagtgggcttaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcacctgtagtcccagctactcgggaggctgaggcaggagaatggcgtgaacccgggaagcggagcttgcagtgagccgagattgcgccactgcagtccgcagtccggcctgggcgacacagcgagactccgtctcaaaaaaaaaaaaaaaaaaaaaaaaaagtaggcttagactcatcaacccctcaaaaatactcagccacttttatgttttcttccccaaccccaagctctcatcctgaggtcctgactgaatctggagcatgcttcagtatctccctaacttataagcgccactgctcattaaggctccctgttagatgagacctctgctgcaacagtctctctgcttgtaaacatcactgcatatatcaccacccaccccagcccagcagggaaaggaaaacaacaacaacaaataaaatgcaattctaggaatagtgagatatgcaagaaggcatcagtattaaactttctgttttgttttgtttgagactgagttttgctcttgttgcccaggctggagtgcaatggtaagatctcggcttactgcaacctctgcctcccgggttcaagcgattctcctgcctcagcctccgaagtagctgggattacaggcgtgtgccaccatgcctggctaattttttttttttttttttttagtagagatgggttttcaccatgttggtcaggctggtctccaactcctgacctcaaatgatccactcaccttggcctcccaaagtactgaggttacaggtgtgagccatcgcacccggccagtattaaacatttttttaaaaatcatgttgaaacttaaaactaggtagtagaaagtacgtaaaacaattaatagatggttttcaaataccactttcaacttaattactagtcattatattttctcttcagagattgaagagccaagacatcattacacctaaatgcaaaattgtgtgtttacatccaaatctctcatctttcttataaaataggaaataaaattttaaagataccaaatgtgtttagaaccattgaagatagtttaaatattgttaaacatttaggggactataacaaaaagttttgttttgttttttttttaaacgagacggagtcttgctctgtcacccaggctggagtgcagtggcgcgatctctgctcactgcaagctccgcctcctgggttcacgccattctcctgcctcagcctcccgagtagctgggactacaggcgcccgccaccatgccccggtaattttttgtatttttagtagagacggggtttcaccgtgttagccaggagggtctcgatttcctgacctcatgatccgcccgcctcggcctcccaaagtgctgggattaaggcgtgagccactgcgcccggccaagaaaaagttttttaaaaattagtgaaaatattagactctgaagaatagaaataataaataagaaaaatgtaaatgactttctcaacaactttagccactgactcccatcctcctctatgccctcaaattcaattttcagtgaatttcgcaggccaggagtcatcattcccgttgctgacagctcagctcctcagcctgggagtatccatttttgaacatgcattttttattgtacttgcttttttaacaactcacattcatggtttcattttagaatatccatggtgtaaacaacacattacttcgtgcaatggagacaatattgcttgattgattttgtattactcaaaaaaaaaaaaaggcgagaaaagaacttttatctgaggaatgtgagtccttttaaataatgaggcccagagagacattaaaatgaggcagcagtcaaatcctactccccgctttgagctaggtattcatcttctgaaactgcttattgccacaagtagctataaattaacttaataatgccagagcaaacgctataacccacaccctgtagcttaataatgtatagccaatcgctaatcaatgttatttctataaatcaataagaatgcctgacaaacaactttgtatcagccatgccttctcccccttttttgccttcaaaaatctgtttgtaacaaaggccaaactcatatccaaggttacatgggtccgagtcctcctgacagctgtcttcactttggctcagtaaactctttaaattatagagtttgtgtctcagcctcttccttttaggtcgacaaaatgatagagctttggaggtcaatatttatcaaaactgccatctttgggaaatcttctgcataaaagagctggatgtaattgagccagatgctgctttattccacagcactgcaaaatattaccctccctttcaactctaccccaattgaaagcttctggaaatactaagtctctcgtggatatttgtgtacattaacttttaaaagaaattctcgaatggcagctttgctgtggcagctgtcaggcatgcatatgaggaaatgtgttgtaagtgcacagataaggaattacctgatgtttctgtagacagattttcaaactcataattcttttcatgttcatcatcttctccccaaattaaaaaaaaattatcgtctatatatttatcttttcagctagggttttcctcatctctatatgcatttctctcattttcaaatatatttttaggacgcgcatgttcagatcatgtggactatatgttatcataacttttgttaaataaaaatatattatccagtatcagctcctcaaacaaaatgactttgggtccataattgctactgaaatgtcaactgacaaaaattcaaatatatttctggcacatcgattatttacttcttttgtatttaaaaatgaaatacaacctgcccaattgtgtaacaggcaaaagcattcttagatcttttacccctctaagaccaaatgcccaactggagcatttatgctgtttgtgcagcattgcccagctgcagagaagcccaaggctcagagggtaagaagtgactggaagttgtcttgctacgtatgtggtgcaggttctttaacttacataaaaatatatttgataagatggtcaatttgcatgagtatttacccaatcagagggtgcagggaacagttatatggagattttttttaagctattacatttacatcatttagaaatcaaaacaagataagttacctaccaagggtaccttccccatttctacgcccatcatagggagctgagaatggcctgactaataaatttgcattagaattaacaaccacagggatggcatactttacaacagcaacccagggacaaggaaaggggagaggatgttaccaagcctagggaaacaactcaggctcatggtgaacagggagggaaactgatagtgtctaactaacacaattttaaattcagtaagaaaatggtttgttagatcatgtagctcacttactcgccattgaaaaatgctgtgagtgtttccatggaaatctgaattcaaaagatctttcctttaatcatattctgagatttacacggaaaatatctaaaataggctttctttttccttgaacattacctactctatattcaccctcaggggtttttctctcaaatgaatcaaatataaagagaaccttgtagaatactgagttgggttgtggagttgacttatcaagtgctatttttctcattctcatcacagctcatagcgtgttgggaaaaaaaatgatgcctgaatagctcatatgggcaggtggtcagtataattgatttccagttatgtatggttaaaatttaataatagaaaaaacatcctccgtaaagggaagtattgagaatacatctataaaatgttttcttaagagtagaataagttaatctgtggataataggtgtgtgtgtgtgtgtgtgtgtgtgtgagaataatccctctaagtcacagatttttacaatactaatatttgaaacacccaagcacgggcacagacaattatgttatgtttccctaattgtccatagcttatcttcaaagaatgaaagaatgttagagatggagggaagaaacagcttaaggaattataagtaacctgcaaaacagaaaagtatatagctgatgttcaccacctttgaatcatgaatagacttgggagactaattttaagaatggcaaaatgttgagacagtttctgtgatgtggtggagtaagacacttcagaacgtgtttgctctgactcactggagcttgtctggcatcaaaaagggtggttcttaattgaccctttgtccaccctgtcaagagcggtcaaaagaacacacaatttagcaggttaaactattttaatttcatcatttaatgggacttcacagtataaataataaaatttactagatgtcatatgaaaccccatgtttcagttcatttgccatattacagcaattttgcaatattgcaactttttcctagtttttataatttcctataaaatgtcttctataatccatctatgtgatttctaagggaaaaagtgatcttatgtaaaaggaaaataaccttggattttcacattagataggaatgtactcattcccatgtctcctggaggaaaaaaaataaagaccctgtcaagaaaacattgacagtactataattagtgagtccatcattcatgatttggaaattgacctccaagaaagtggagaaaaaaccccctgtctcacagaaggcaaaaatcatttccatttatgtcaaaataccatcctttaagaagaaatggagggcactgattctgatgagaaaggggaatgcaagtcatgaaggaattgtgaaataaacacacagagaggatctatcctgtcattttatctctaaataaagaactgatcgatgtcttggactcatgttgatgagtagtgagggatggatgtaacactagcgtctgtgcccagatacacgaggataaacgacgtgctacttcatgactctgaggatttgctgccaagatggatatttaaagtgcagaaattcttccacaatattgctgcccttacagagacagggcattggttaggccctgtattttatccaggctaaccccctcatcatacagatgaggaaaatgagtcctggaaaaattatgatgacagaactggtgaactctgacacttcgggttttgaccttggctaaattcttagattttgcccaagaacacactctaaggtttctcgctgtagtttgactgttttgttctgaggattttggaaatagtatctcctgacaggatttctgtgttttttgctgctcaactggctctgaaatttctgaacatgccttatgcagtttcaacattcttctgtaatctctgctgaaacatttttgtacctatattttatatcgatactttcagtgtgtgtgtgagtgtgtgtatgtatgttctaggacccacttgagaaagattacccagtcaaagttcatataaatgctgcatattgttaggtattgaataagtatttggtatctctttatgttatgaagaagtaaacagtgtatctgcgtttaaatatgaagacagggttacagtggaggcatgatgctatcatctagtgacactcatcttgcagtatcatatttttactagttaagtgttctttattttaagtaggaggtacaggattctgaagcatagtgtaaaagattggaaaaggtttcacagggaaacctgtgggtatgaatcatacatgctgtggaaaccaaggatcttctcaaagtcatagttactggacttcatatgaagccctgtgattaaagaagcaagtcagcttagtaatagccaatattgactgaaaatctgaagggcatttgtttaacctccttaaatagttgttatccaacaaatctgctaaaaaatagttttcaattatttagtacttactgcctttgttcacttaaacacaacttgcaaataagaagtagttattgcaaaaggtagaaatgatcatccaatgtgcaattccttgtcatgaaaaccctccaaggctggtttaaaacagaaacttccttaaatgttctgcaaataaaaattcaagataattaaaatccagaacaaaagagaaaatatttacataaaacacacttctacagtattttaatttattctgaatcatcattgaatagaatattttaatttgttcaagtaaatattttactgtgttcatgataggggcttagtatttgcaagtgatgggccttgttaatcttcagaataagtttaaatgacagctcagcagggcagcgtctcccgtgcagcagcccctgtggagcagcaggaaggaaggctctggaggaagccgcaggaagccgatggctcctgtgagagactgcctgactgatgctgtcacggtattgaccctctccctaagagccctgagatcacactcgccctttttacatcacccaacagggctgacttaacatccagggaggacaaataaaggggaagaataaaatagtccaacaaaaccaggacagaatgcacttatgtcattaatggagctacattcttactttgaatgaattacctacattatgttaccttcctaaagacttactgaaaaaaaggtgttcaaggaactaagggaaacccagggtggcacttgaggttgagggtcacagaccacactctgaatagccctgaggctgggtgcagggccaggctgcctgtgtgcagatctcctggccgtgtgttagaggttgaaccatgcatctctcagaattcaaatgttgaatttttattttatttttatttatttagtttttttgaaacagagtctcactctgtcacccagactggagtgcaatggccctatctcagctcactgcaacttccaactgctgggttgaagtgattctcctgcctcagcctcctgagtagctgggattacaggcacctgccaccatgcccagctaatttttgtacctttagtagagatgggtttttgccatgttggtcaggcttgtctcaaactcctgacctcaggtgatctgcctgcctcagcctcccaaagtgctaggattacagatgtgagccaccatgcccagcccatatgttgaatttttaaacactgagtactgcagaacccaggaattatttggacatagggtctttacatgggagttaaaatgaggttgttgtgaagggaccctaatccaatttgactaatatccttgtaaaaagggaaatttggagacagacacacgtagagggaagatgatgtgaagagatcaaagaagaagacaggtgtctacaaaaccaggaaagaggcctggaatagatgcttcgttcatagccttcagaaggagccaaccctgctggcaccttagtgttagacttctatcctccagaactgtcagacaaaaaatgcccattgtttaagtcacccagtgtgtggcactttgttatgatgtctctagcaaactaatataccttgtgaccttggcagttgtgtcttcctgcctctgtaaaatgcaaatattactgatatattacctcctagggcttctgtgaagaggagatgagttaatacatgcaaagtgctacaatagtgcagacgtaatattaatactcagtaaatgttaagatgattattaatatcaacatcatcatcaccattgtataaaaaaaagaaaattggggctgatatctgatctctgcaactttaccatgcagcatccctgtccattgctttttctaaattctattattaaccttgagtgtcttgtaattgatcatgtttcaacctttctttgacagcaagtactctcagaaataaaagtattactcggaccaagcaattgaacaacatattcatgcatttatgttcatgtagaaataccaattatacacgttttattttattttattcatgactctattttgtatcttatacttttttccccattgaaatgaggtgaattaaaaataaaaactttataaattaattagctgcaaaaatacttatttttgtttgtttttccaaatggttgcaacttacatagtgtaaaatacaattcatgaaagtggaaagatgcagaaatcagaatggaaatgagaaccagcaacctgagagtcccacagaaatattcagtcacatctgtgtaaccaggggctgtacagtcttaggtggaggtattccagatttttgtttcttagtttctgtcagatgtaaaatgtgtatgtggaactattgtacactttctttgtttggtagagacagtctcgctgtgttgcccaggctagtctcaaattcctggactcaagtgatcctcccacctcagcctctcaaagtgctggtactacaggtgtgagccaccatccccagcctactgtgcattttctattatttgaagcaaaattggggccacaaagaaggtcatctgtagtatgccaataacataaacctctgacatttcagtaaaacattgcctttgcctctgcatagtatgccagcatgttctgcagggtgggcagccgcaagcagtggttagaacaggggctctagaaccagggcctgaacctgaggctgtgctctgctctccttaatagtgaaatcagaggcaagttgcttgacctttctgctttgtgtttctgcttttgcaagatgcacaatatctggtttgtggagttttttgaggactaagggagatagtgattcctatcaaatgtttaccagagcctctgataatctgggttttctccctccacttccttcccctccttacttcttcaagatgattctatttaatggcatgttggaaatcatgtcagcagtcataacatgccaaggtaaaatgaaacttttttccttaaaagtaggagaatgaggtaagagatgattttagaagttaaagcctacccaaacataaaaggatatgatttgtgtcactgtcatctaaagtgtctactgctacattttccatggggctgaagttttgattaaaaagaataatgtcatatcccaggtgtatccctaaattggtaactacttccgaaagtcttttttaagcttgtacttaaatgacatttttttaaggataatagttttgtattataaaagataaatgcacaaagcagctacatgtaaaatgccactttaggacatgctgttctaacacaaatactgtcaacatctcatttgtgagtgaactgacaagatgtccagggaatgagttacagtggagaaaattcaacgtgcatcacagaatagttaccagctcctggccctccacagatgtggacctaaaaccacctggagggcagagtcggctccctcccgctgtgagtgcttcctagtgagccagcagctgaaggcctccctagcttcacttctccagagtgggcatggagataactagtgaaagtggtcacaaagtcggggccaagaagtctctaacccctaaatcaagattgagagatactggaccgggcacagtgtctcacacctgtaatcccagcactttgggaggcctaggcaggctgatcacctgaggtcaggaattcaagaccagcctggccaacatggtgaaacccagtctctactagaaaatacaaacaaatttagctgggtgtggtggcaggctcctgtaatcccagctactctagaggctgaagcaggaagaattgcttgagccccggaggcggaggttacagtgaacccggatcgtgccactgcaccccagactgggcaacagagcgagactcagtctcaaaaaaaaaaaaaaagcaaagaaaagaaaaagaaaaaaagatggagagatactggagaaattcttcctttatgcatccctcatccttgcatcaattttttcctacaaatcaatggaatgtgcacatatggggcattatttcacgttaaaggaactaagtccatataaatgatttgttttttgagaggtgaggtctcactttgttgccgaggctggagtgtagtggtgtgatcagacctcactgcggcctccacctcccaggttcagatgatcctcccacctcagccaccctagtagttgggaccacaggcgtgccactgtgcctggcaaatttttacatttttttgtagaaatgttgtccaggttggttttgaactcccgggctcatgtgatcctctccccttgagctccctatgtgcaaggattacagctgtgagccactgggcttggccaagtagaaattatatcctgctactagttgaccaaacatgattcataaactataactagtatggccgccattaatctaaaaattaatttttagattaatgtttattgacagtatctactctataaaataaaaaaataaaatatgcttttatgatgtggaccatagtatccataagattgcttttctgtttgaattggctataaaaatggaaaaagtatcattttgtaactgtgtggcatttgctcatttattcaacaataataccagagtggaaagcaacaagttaggtgtgacataatatagaaatggttttgttttgtttgtttgttctacatatattattagtaaggtttctctagagtactgtctctctctatctctttctatctctgtctacacatagacacacacacacacacacacacacacacagatgttcctcaacttacaatggggttatgtcacaataaacccatcataagtttgttacaggaaagaggtccagatccagaccccaagagagggttcttggatcttgtgcaagaaagaattcagggcgagttcacagtgcaaaatgaaagtaagtttattaagaaagtaaaggaataaaagaatggttattccatagaaagagcagccccaagggctgctgattgcgctttttctttttttttttttttgagatggagtcttgctctgttgcccagcctgaagtgcagtggcactatctaggctcactgcaacctccccttccagggctcaagtgattctcctgcctcagcctcctgagcagctgggatctcaggcgtgcaccaccaggcctggctaatttttgtatttttagtagagacagggtttcaccttattggtcaggctggtctcaaactcccgaccttgtgatccacccgcctcggcctccgaaagtgctgggattacaggcgtgagccaccacacctggccggttgcccatttttatggttatttcttgagatttgccaaacaacgggtggattattcatccctccccttttagaccatatagggtaactttctgacgttgccatggcatctgtaaactgtcatggtgctggtgggagagtagcagtgaggacgaccagagtcactctcatcgcaattttggtttgggtgggttttggctggttgctttactgcaacctgttttatcagcaaggtctttatgatctgtattttgtgctgacctcctatctcattctatgacttagaatgccttaaccatctgggaatgcagcccaggagatttcagcctcattttacccagctcctatttaagatggagttgctctggttcacttgtctctgacaagttgaaaatgcatttaatacacctaacctactggacctcatagcttagcttagcctaccttaaatgtgctcagaacacttacattagcatacatttagcctatgtttgggccaaatcatgtaacacaaagcctattttataatgaagtgttgaatatttaatgtaacttattaaatactatgttgaaagtaaaaaacaaaatgcaatctttattattttagctaaaataattgtcaatttattaaataaaaacaaaacagcccacaccatcattagctgcaaaatcattttgaaccattgtaagttggggactgtctaaagaattgagaattggctcaagtaatgacagaagctgattagtatggaaatttgaagtcagcaagttggagacccagcagaggtaaggtatagtccaaaagcttgcagccttgaggctcaagaagagccaatgttttcgttcatttacgaatgtaggaaaagaccaatgtcccagttcacacagtcaggcaaaaggagctccccagtactcacgggagggtcagctgttttgttctattcaggcctcccaccaagaggataaggaccatccatattggggagtgcagtgggcttcactcagctagagattcaaatgttaatctcattcagaaaacaccctcacagacacacagaataatgtttgaccaaatatctgagccaccctgtggcccagtcaaactgatagtttttccttaggttatctccagtgtcatttaaatattaatatttatagtatattattgatgtaaatattaacatttattacccaggggttgtgttctcttgataatgttctatttttttaatctctgtgaaaaaatgttttatgaagtgtggaatttatctgctacactgacatattctgcattaatctttctctattttgtggttgtcaatcactggtacagtttcagagagcaggaaatgaagattcagcctttaactcctacacaatccacagtgtttttttcccctcagaactgtcataaaaactgttgtattttatttagatttttaaattaacaactaaagccatattctagtaatactttaataatctagatttcatattttagagtagaaggctgcatcatatttaaaatcactgcagagactttgaggttttcaaattaatatcatattaaaaatttttgcactctgaaggctttcatttattgctttaaaaaaatgttgaaactcagagttcaaatgatttaaaaaactctacatctagatacagttaaggtaaactttgtatatctctgtaatgactttcactgcccctcattatcaatcaagagcattgagataaggactggaaaatattaaagatatatgttaatatttatataaacatattaaatgtgtgtgtgtcacacatacacacacacacagagcaagagaaagggcaagagagggacagtaactgtcttcagaatatcaaaagttctgctaatcggctcttttgcagaagcttgtcctcactctccgcataggggaaagagaatgagcttaaagacagaacttcctgctgaattaattaaatatatccattactactgacagaatcagtgaggttaagcccctctgaagatgacaagataaattgtcactattatggcactagaaatgagatactgggataagatttcattaccgtattatcacaggtttacttaattggcaaagtttcacttaagaaggatgcagaaattctgaacacaagttagcatttctagcacgatggtacaagatgtgttattgagtaagtcaaagatgccataaacgcaaatttcaaggaatggtgtaaggctcgggtggtggctcacacctgtaaccctagcactttgggaggctgaggcaggtggatcacctaaggtcagaagttcgagaccagcctgaccaacgtggtgaaaccccgtctctactaaaaatacaaaattagctgggcttggtggtgggtgcctgtagtcccagctacaagggaggctgaggcaggagaatcgcttgaacccgggaggcagaggttacagtgagccaggatcgcaccactgcactccagcttgagcaacaagagtgagactctgtctaaataaataaataagtataaaaggatggcaggaatgcaaaacttggtgcacagtgcgctgcagtggtgccgcctgctgtctgatggaaacatcacaaagacataagcacagactaagaaaaaaagttttaaaagtcaaagggataggtaagtaaaaaattgaatgcaatatgtaggaaatgctgctttcttatttttatttttattatttatttatttatttatttatttatttatttatttatttatttttgagacagagtctctctctgtcgcccaggccggagtgcagtggtgcgatctcggctcactgcaagctctgcctcccgggttcacaccattctcctccctcagcctcccagaaatgctgctttttaaaagtggccactcttatgctaataaagccatccatgagacaagaacgtggttaaaatataatagcacatacagaaagcaatactgctttgtccaagtcagtcccattagtcctggcatgatttctatagcactcctttcaaataaagaatgtcccaatttaaatgaagaacactatataatcatcctaatcataatagcaagattaagtcatcatttgtagtaaaatcttacaacagattgtgattggctgtgtagtgacaaaataattggaaagtggcaaataaaactggtcatagagggtcttagactatatttgttgccttgaagacatgatgggagaattaaacttaataaatgacctcggcctagatgaaatatccttcttaaaccaaatatttctgcaaggtatggattgaatcttcataccaagtccaacgaatttttgtcctgctggaaactaattgagaaggaaattaacaggaattaaggtgagatgaacaaggtgagttgcaaaagtgcaggctcagatcctgctaaattttaatatttgctcatggtgacttttttgcattaattttaatatttttaaataatgtattaaaacattatttattttgattgctaagttttgtgcttacccatttaattgtgttcctaaggggagtacctcacttacctcaccttgtaacagattctatacaaggtatacctgggattagatataaagaacaatgaagtcagaactgtgttatgggggtttccactccagctacctgaaactgaggttgccctatcttagtgagttcaaagctggagattctgtaaatagacacggggactgtgaggtccctgcacaaacaggtcatatctgtaaattaaactttgtgattataataattttttttttgagatagagtcttgctctgtcacccaggctggagtacagtggtgcaatctcagctcacagcaacctccacctgctgggttcaagcaattctcctgcctcagcctccagagtagctgcgattacaggtgcacaccaccacacccggctaattttttgatttttactagagatggggttttgccatgttggccaagctggtcttgaactcctgacctcaggtgatctgcccgccttggctttgagaacaagaacaccatgtctgctggtgtgttagtcgattttgtgttgctataaagaaatatgtgaggctggataatttataaagaaaagaggtttatttggttcacagttctgcaggctgtacaaaaagtgtaatgacagtatcagcttttgctgaggccacaggaagcttacaatcattgcagaaggcaaagtgggagctggtgtatgacatggtaagagagggaacaagagagatgccagactttatttatttatttatttatttatttatttatttgagacagagtctcactctgtagccccagctggagtgcagtgatgcgatcttggctcactgcaacctctgcctccaaggctcaagcaattcttgtgcctcagcctcccgtgtagctgggactacaggtgcactccaccaggcctggctacttttttgtattttagtagaggcgagctttcaccatgttgcccggggtggtctcgaactcctaagctcaatcaatccgccggcctcagcctctcaaagtgctgggattacagccgtgagccactgtacccggcctagactcctttaaacaaccagcttttgcatgaactaatgcagggaggacttattcgttactatgaggaaggcatcaaaccattcatgaggtctccacccccatgacccaaacacctcccaccagggcctacctccaacatgggaatcacatcttaacatgagatttggaaagaacaaacatccaaactatatatatatatatatatatatatatattttttttttttttttttttttttttttttgagatggagtcttgcactctcgcccaggctggagggcagtggcacgatctcggctcactgcaagctccgcctcccgggtttacgccattctcctgcctcagcctcccgagtagctgggactacaggcgccggccaccatgcccggctaatttttgtatttttagtagagatggggtttcaccatgttagccaggatggtctcgatcttctgaccttgtgatccgcccgcctcggcctcccaaagtgctgggattacaggcgtgagccaccgcacctggccatctaaactatatcagctggtggtttgccctaagcttttctcccccaagtttcttttttcagaaataaagtttgtctttatctgacgtcagcagattggtgtttgcttttgcctgctgtattcctttagtttctaaaatagtccaaattcctcacccttccctgaaaatgttgctcttacgttgacataatatgtctagtttcattcagtggttaatattataatatagtactcagattagagtttgcagctgttgtcgttaaatttaggtcattctaaatttacaagttagttgggaagaaaacaaccgcaaattctcaaccctcatcaccatttctgcctctcagtgctcatataaagtcactacagaaaaagaaggaatgcagcaattaaacaagctcatctgtaacacgattaatttttaactctttaattcacttgtttctcataggaaactacattaacatgacagggttttttttttgtttttttttttgttttgttttgttttgttttgagacggagtctctctcttctcccaggctggagtgcagtggcgccatctcggctcactgcaagctccgcctcccaggttcatgccattctctcgcctcagcctcctgaatagctggaattacaggctcccgccaccacgcctggctaattttttgtatttttagtagagacggggtttcaccatgttagccaggatggtcttgatctcctgacctcgtcgtgatccgcccgccttggcctcccaaagtgctgggattacaggcgtgagccaccgcatccagccatgacagtaatttttgaaaatgaattggcacagcaattcaagaagaggaaatcggacccatggtctctaaaggacttcccagcaataatgtgctgggctgttcagaagtatcactgataaaaggctatgcccatgtgcacaactggcctgacctcatgtgcatatcagttcacctcaaccaccatcccgtctgctaaaataagtcacattggttgcctcccaaagttctctattcaaaccagtaaactcagttaaataggttgtgaataggaaaatccaaaagtcactgggaaaagatgttataaactaaaatattcatagaaacattttttatgaaagccagaaaaggaaaaataaacaactaagatgcctaaaaaccaaaaaatggatgaataaaatgtggcagatgcattcagtggaatatcatatagcagtgaaaattaaggacattaattacatgtatcagcatgcctgaatctcaaaaactcaagttgaacaataatagcttttaaaaaaacacagagttaatatgtatgttccaagtctacgaagtctttaaaaagaggaaaaacaggccaggcgcagtggctcacgactgtaatcccagcactttgggaggccgagatgggcggatcacgaggtcatgagatcaagaccatcctggctaacacggtgaaaccctgtttctactaaaaaaccaaaaaaattagccagacgtagtggcgggcgcctgtagtcccagctactcgggaggctgaggcaggagaatggcatgaactcgggaggtggagcttgcagtgagccgagattgtgccactgcactcccgcctaggcgacaaagcaagactccacctcaaaaaaaaaaaaaaaaaaaaaaaaaatagggaaaaacaaaagagtatattcaaagaatcacaaacaaaaagtaaaggaatgataaacaaaatttaggatagcatttaccttgaggactaataaatattggtaatgtttaatttattaagctaggagatggacacatatattttcattcatagaactttttttcctaaatgtatgtgtatgctatatgtcacatgcatgacatatatgtgcatgacatgtgatatatatgtgaactacatatagttcacaaaaactaaatgtagatatggtatacaatcacacaaaggcacttaatgtatcaatgtgtctatatatacatttatgcctaacttatgacaataaatatactctcaaatacctggtcatcattaaatctaatacgtagaatattaaaatatgaaagaggatgctgtatttgttattagtcatttttctccagtctattttcttttgcatcatttaataaattagtagagaactttcctcccattccttttagtgttttaaaatcttttaatttaaaaattatagctcttagataattgccttatgtattgtttttaaattttgtttcctatgggttgctgtaaatctatcctaagtggcaaagttttaaaaacaatatgggtcaaaagtgcacaaagctctgaaaatgagaaaagaaaatgaccaaacctttaagattcctagcattattctgcctatcaccataatgtttgcttggagggaggcaggctatgaactgaacaacctaatttatggctgatgtgctctctggccattatgggcagaatgtgagcttcttcacagcagtggctctcagcatttctcttcacgttctatgggctacagcaagtcacatgaccaatcccaactccattgtgtcagggatgtataatcctcttacttggaggacagcaagtaattgggaacagtaatacaatttggcacacaaaacaaatcttcagagagtgtcagggtcaagagaagcatttgtccgagaaaaagttactctaaacttgcaaaaagataaaaatcataatgcttgattaaaaaaatactgaattattttctaattatttacttgaccctaacctgacaacatttataggagtgatataaagtcagactatttacagactgtgagtctagaggtcagcagcaaaatttagaaattatcatgactctgtagcccagtggtttactgtcataaaagatatattttataatgaaatagaccaccaagtagaacaacagaccactgaaataaaccatcaaatgacatcctataatttaaaggtatgatgaaaaatggaaagagttgtaaatgtttcttctagagttgtcatttggtgcttctgttggaagggctatggaggaggccgggcgcagcggctgacgcctgtaatcacagcactttgggaggctgaggctggcggatcacgaggtcaggagatagaggccatcctggctaacacggtgaaaccctgccactactaaaaatacaaaaaaatcagccgggtgtggtggcaggcgcctgtagtcccagctactcgggaggctgaggcaggagaacgacgtgaacccgggaggcggagcttgcagtgagccaagatcgcgccactgcactctagcctgggcgacagagcgagactccatctcaaaaaaaaaagaaaaaaaaaagtttgacacagtttgatctttttctaacacctggtggcatttttacagcataacctttaaaaagtcattctagaatatcctaatagatgtatacatccctctacctaaatttttgtagatgttatttgcctacatagtgaatgacattgtatttcagcagaatttattattcaacttttaaaaacaaagctcctgcatttatatccattttccatatctctatgtcataaagataatgaatttaattggacaattttctttcaaatgtgtgcagcctccttccacttccaggtctgaaagaggacagtatattttatagaccacacgattgccagagtggaaactggagtgagtggaagattccacatagttttacttgtgatactctagagactagtggtgaggtgtcttggagatggcataataatacaaataactaaatattactgagttgttactgtatatggcactatgttaaaggtttcataggcatcactcctcatcacaaccattttttttaaacagctttattgggataattcatatatcatacaattcacccatttaaagtatacacttcagtggtttttagtatgttcaggggttgcacagccatcaccacgattaattttagggcattttcatcacccaaaaaagaaactccatgaccattagtagtctttcctcatttctctcctccctccatctatcctctcctcaccatccctcggccccaagtgattgcttatcttctttctgtctttatacatttattatttcctggacatttaactatctaagtgtaattatatatcttttggccagtatcttcccattgcccccaacatcccagtctctggtaacaaccattttactttctacttctatgacataaactttttttttttttttttgagatgaagtctagctcctgtcacacaggctggagtgcagtggtgcgatctcggctcactgcaacctccacctccctgggttcaaatgattgtccttcctcagcctcccaagtagctgggattacaggcgtgtgccaccatgaccggctaactttcgcatttttagtagagatggggttttgccatgttggccaggctggtctcaaattccggacctcaggtgatccaccctcctcggcctcccaaagcgctaggattacaggcatgagccaccacacccagcccaactttttagattctacatgtgcgtgagatcatgcaatatttctctttctgtgcctaacttatttcacttaacctaatgtcctctgggttcatccatgttgttgaaaataacaggatttcattctgttttttggttcaatagtattcatatatataccacatcttaaaaatccatgtattcattgatgaacacttaggttgattgcgtatcttggctattgtgagtaacactgcagtaaatgtagaagtgaagacatctctttgacatactgatttcattttctttccatatatgccataagtgagattgctgggtcatatgctcgttctagttttaaggttttgaggaacctccataatgtttttcataatggctgtactaatctacaacacaacccattctaaaatctcattttaaagatgagaattatggtggatcagccattcatccatggtcactcagccagcaaagttcagagccaggtcaggaacatcacctgtcctctgcctcaccttgaaccatttcttgtgttgccttgcagggagggtgttgcctgccccctcatgtgtcagtctgttaagtccagtagtgaaggaaagtgttcacatgtccatatgcactgcagatgaagagagtatggaagcttggagggagaaattgctctctttctttctgtcctttttttttttttgagacggagtcttattctgtcaccaggctggagtgcagtggcacaatcttacctcactgcaatctctaactccctggttcaagcgattctcctgcctcagcctcccaagtagctgggattacaggcagatgccaccacgcccagctaatctttgtatttttagtagagacggggtttcaccatgttggccaagatggtttcgatctcctgatctcatgatctgcccacctcggcctcccaaagtgtctgtcctttctttattcaccagccacaatgacacacagaacatagtaggaagaaaatagtttatatttattcctaagaatataaacttctgttaccattctaaatttccagaaaaacttattgtgagtgctaaactaatatcatcctgacctaagacaaattgtcagttcctaagggtgagatttataggagaaaaccatgtctacgcttgaggcagagttcttagtagagatacaatagccagttgctattatttcaaagtttgtctgtccctaaatattgcctgcttaggtctgactatgctaggattagtgatcatctgctctgaattaaaggtttagatgcactcttcccaggataaaattaagtttggggactttctcttttcctgggagcaaaaacctcaggaactaagtgtgccatatgctggaagatggaaacattccaacagccagaagtagagggaagataaaaatggcttccctaaagcaaggcaaatcagcgacagccagtcctgtggccaccactaatcacttgtaaatgaatgctgcgatgtgtttcaaaagccctcattctgactctgcctgatctgctactgaaatgttaattatatgcctaatcttctcttgcaagcaaaggcagcagagttgctaaagatcatagcaggtaaaaaccttcaaggagaggtaaggagtaaatggagctgggagggaatgctgtctctcaggacagagcctggctcattgaaagggcatagtcctaccctataagggatgcctcccagtgtgaccaggtcttctatgatttctttttatgagaaaccagaaatctgattatgttcatgagaaattggagttttacaaattagcaaaactgtgctgtgctgagaaaatagaataaacctgaaggccagaggtgtgctgggagagtcacttacagaaccagagcaaatacttacatagagcaatgatgtgttttaataaaaacagggactactgtgctttgtaaatgtctttatgccttctaaacgtcctttctcctgaagtctataacgtgacatgggatagcaaagtattttttggcatgaaccattgcattgaatatcttaacccatttgtgttgctattaaaaaaaactcctgagactaaaaaatgtatttaaaaaagaggtttatttggctcatgattctgcagcccatacaggaagaatggcaccagcatctgctcagcttctggtgaatttctgaggttgcttccacacatggcggaaggcaaagggaagccagcatgtagtgagatcacatagtgagaaaagaggaaagaggggggagggggtgctaggctctttgtaacaactagctttcttgggaactaacaaagagctcattcatcccctctccccggggagggcaacaatcttttcatgagggatctgctcccaagaccctaacacctcccattaggccccacctccaacacaggggttcaaatttcaacatgaggtttaggagacaaacatccaggctatgtcattggatccctaataggctgaagtaatgtgttaaaaataagttgtaaataattatatgcaaaaacacatagcattttggaaactttgcaagataatgaaaatatttatctggattttaacttaattcactccatattctacacaaacatatttttaaaagataatacaatatttgagacattaatatatgttagataaccaatttacatcctcaagagctaagaaagtgttaagttgccctttcttaataaaaacaaaatttatgatgttaactgttttttgtttgtttgtttgttttattgagacagagtcttgccctgttgcccaggctgtagtgatcatggctcactgcagccttgacctcctgggttcaagtgattcttccacctcagtctttggagtagctgggattacaggcgcatgccaacatatctggttattttttatagaagctgtgcttcaccatgttgcccaggctggtctcaaactcctgggttaaagcaatctgcctgtcttgaccttccaaaatgctgggattttaggtgtgagccactgtgcctggcctatgacgataacttttttaaaagacaaaattagaacaaatttagttatggatgtaattggcttctatttgtaagtcatgaatcagggcagccggcattctacaaaataggatgagagcttccacagacaatggaagaacagtagcttctgtaaaatgagaacaattaaacaaaacaatagacaaaaagctgattggttaagatcagggttaatccaggttaatttgttgtaagggttaaagcagagaaaagttcctttttgcactgactcaggtagaccagaatttcctgtcttgaggaaaaactgctctgttctgggacctgtgtactttcttaaagtttcagtttgattatgtggtttaacatagcacatgaataacaatgcgattattttaagagttattataataaattttgataaatttgctcaaagtcattatctctaataatcaaattatctcaaatttaattaattgcagtatgtgtcatttatttcaaaagtgaaataaaaaccttttccacaaatcacagtttagtttattttcaaattcaaactttacttgcttcattgaatctagcaaaagtaaatgtttcaaaataatgcaaaaaaaagaggtttgtaaagttggtaagaaaatatttgctgagcaagtaatcagatgtttattgtcttacctaggtcatttcttatatatttacattcacattgatttgtattagctatcaagttaatcatgttaaaaaaagtggtaccataatgaattgtgtttgatgttgaaattaatatttaaagatttaaaaattatgagagagtattctgtgttatctcagaatactggtaatgtcttaaagatttctggctacaaagtagttttacaagacattagttttatgggcactgcatgcattgcattgatcaaagcagcattgcattggtatttaacactaggccatgactgaaaggtcttcagaagacatcatgatgaactacatacagagtaatggcaagtttactgtaaaattaacattctcagttgtcacaagaaatctgacaatcactaaaatggcaagcactgtgttctatttgtgtccttttcagacatgattgataagaatttgttaccttattagcatgtcataagtagacagcaaagtatgttttaaattcaaaaattattattttctgctcatgttctactttcagcaatgtacacagtgatagtaatgaaagcagccatcagaatactctattttcttcatagttagctgccaaatacttctttttttctatccagatcatacttgtattgcttttgtgcctttgagcatagtcataaattagtacacagaggaagcagggcagtgacagctatacatttttctacagaagatcagctattaaatcaagaaccaagagaaccatctcagcctggacactgagaaccgaagccacaccttcccactgatattaacatgactttgttattctattgttccattagtattacttttcgaggactgtcctagctaaagaatggtttgatttttcattataggaacttcccaaatgctttatcaactcttcaggggaagtcatagaccgagtttacagcttgagtctttgaatccttccccacaaatcctcacctcactattttctctaagcccagactgttgtatcatgattctcacacaattctaatcaaatcctctccttcagagacccatcttaaaacaaacttgcagttctcaataaattctgatctccccttctctcctctgagatgctgatagaaatttacaaaggctgtactctctcccttgccagtgtattagttttctattgctgctgtaacaaattaccacaaacagtgttgtaaacaatccagacttgttatcctacagtcctcttggtcagacattccatgtgggtctcactgacctaaaattcaggcatcagcagggtagaggttcctcctgcaggctctgggctcctgtgtctgacttttccagcatctagaggctgcctgctgtcctcagcccctggccccttcctccatcttcacagtcagcagtgataggctgggaggccttctcacgctgccatctctttggttctttctcttctgcccccctcttccacttttaagatcttgtgattagccccatctggataatccaggataatctccctatttcaaagtgagttaacaactttaattccaaatgtggtcttaatttccatttttcatgtaagttcacatgttcacatattccagagatgagtgtgtggacatctttgggaggtcaattattttcctgccacataggtaagcaataaacttcgcaataagctgggtgctgtggctcatgcctataatcccagcactttgggaggctgaggtgggtggatcacctgaggtcaggagttcaagactagcctggccaacatggtgaaaccccacctctactaaaaatacaaaaattagctgggcgtggtggcaggcatctgtaattccagctactcgggaggctgaggcaggagaatcgcttgaacctgggaggcagaggttgcagtgagccgagactgcgccattgcactccagcctaggcgacaagagcgaaacttcatctcaaaaaaacaaaaaaactttgcaataaataagcaatcaactttgtctcatcaacatgttatgttggtgataattggggatacagctttgacaagcaattagcacaaacatgacctacttgcagaagcttgtcatagctattattctaaatatggtaatagatgactgtaataatccaagccaagaattatgacattttaaaggcacacacactcttactcctgaaatatcctcaaatggacattaacatacaaatattttaattagattcttttaaattcttaagattatgtgatataacccaaaaatggggctgaaatgtcaggtgacaataacacccaaatggaggttccactcagcacttccagggacacccccccccaacatatatacactctttacagaaacatatttggaaatgaattcattattcataagtagttgtgaatagttagaaaatagattttacatttcacattcaataaaactcccacagaatgtcaattctcattattcgtggattttgtattttcaaatccaccttcttgctaaaatgtatttgtatttgcaaattcacccacctgctaaaatttattactaaccccaaaattcacactcacagcaccttttttgtcatacacagactggccaaaaatttcattctcccagcttgcacattcccagctgatgttgaacaaaaccgtgttctgccttcttgtttcaactctcatactaaaatcaagtgtccttttcacaatctgtttagtgtcgcggttttcatatttttgtgcttttttggtgattttgatgtttacaatggcccccaaacatagtgctaaagtgctctcaaagcacaaaaagaccgtgatgtgcattatggaggcacatgtgacataaactttgttcagatatgacctacagtgccattggctataatctcaatgctgatgaataaattttatatgttaaataaggtgtctttaaacagaaacacatataaaacaagattatgtcttgatcatttgatgaaaatgttgcagccagaggctcacagaaacttccccttacattttcccaagaagcaacaatttagtacttgctaatgttggagctctgaaaaccatatcctcaaaaatggcactttgacatgttgagtgctttgaattaaataaaattgaaaggcctcagaaataagcctcaggaccaacactctgtctaacaccatcagcccccccaaccccaccctactgtattagtctgttctcatgctgctgataaagacatacccaagactgagtaattgataaagaaaaagaggtttaatggactcacagttccacatggccggcgaggcctcacaatcacagtggaaggcaaaaggcacaccttacatggcagcaaccaagaaagaatgagaaccaagtgaaagaggtttccccttataaaaacatcagctctcatgagacttattctgttgcaggagaacaatatggggatatggggggaacagcctccatgattcaattatttcctactgggtccttcccacaacatgtgggaattatgggagctacaattcaagatgaaatttgtgtggggacgtagccaaaccatatcacctaccatcctctttctttcctgaagcaaggaagcaagaaaggagaggcttttgctgaagtttccttatctgattaagtctgaccaagggaggtttctccagaagaaatgcagtgtttttgtttgtttgtttgttttaatttagcccagtcaaattgacatatacaaatgcagggtttttttgtttgtttgtttttgttttttgagacggaatcttgctctgtcacccaggctggagtgcagtggcgtgatcttggctcactgcaacctttgcctcctggattcaagcaattctcctgcctcagcctcccaagtagctgggattacaggcatgtgccaccatgcccggctaatttttttgtatttttagtagagacaaggtttcaccatattggccaggctggcctcgaactcctgaccttgtgatccaccgacctcgacctcccaaagtgctgggattacaggcatgagccactgtgcctggcctgtttttttgttttttgtttttttttttgagacggagtctcgctctgtcacccaggctggagtgcagtggcgcaatctcagctcactgcaagctccacctcccaggttcacgccattctcctgcctcagcctcctgagtagctaggattacaggtgcccaccaccacgcccggctaattttttggtattttttagtggagacggtgttttaccatgttagccaggatggtctcgatctcctgacctcgtgatccaccctcctcggccttcccagagtgctgggattacaggcgtgagccactgcaccgggccagaaatgcagatgttttaaaactccctctctacagatcttatcatataaccaggaaagagtaaccaccagagaggagaaaataagtcattaccatgtccagacagacttttcatctatccttctgagggcagctcagagagattatgggaaagattttatctgcataatgacaacctttgtttacaatgaagttctggtctcacctttccataatttgcttgtacctcccccagagctcagacgaactttgtaccaggccaattgtcttttctttgagctcattcattttccctaaaataatttactttccctctagatgtgcccacagtcccccttttccctgtcccctgtgaataggatatttaagaattaaccaactagagggcatttaagccttaaccaaagcccttctttgagtctcatatttttaggacttccttctccatgtgcatattaataaattgcatgcatttttcccttgttaatctgtctattgtcagctcatttcagcagtgaactatcagagggcagaggggaagatttctctctgcccctacagtaatttgatatttacagaaactttatagaacataactactgtgaataatgagaatcaactgtatatgtcacctttgaatacctctcttctctcttcactgcattcctttggcacagagatggagccaaactctagtggctagggaagtaaatgaaagactgggtctgagtcacctgtttccctaaaggtagcatcaccctctgaaggtgccccttacaggcctctctgggaagggtttcacaatctcctcccacactttacagttggcaaattatggagccaagggccaaatccagtgcccatttgggcaacaagctaagaatgttttttacattaatgacaggctggggaaaaaaaaaaacagcaaagaaaataatatgacctaaaactgtatgtgacacataaagcctaaatatttactatctgggcctttacagaaaaagcttgctgaccccttctttgcagcctcaagtatagcaaatatctagtgtttgggaaataatttaaaacaaaacctgttcaggaaacctctccacaaaagtagaatagatgttgttgaataagcactaaagctcacttcaatgtgcatcacaagaaatctgccaaagagattgaaaaacagacagaaatctcaccctttcatgtggccaagtaggtagaaccctcacatacacgttctcaagattgatgataagttgtttgcaagtaagtaaaaggacttgacagcaccacttgccacatagaattcatcccagattcactgggtaattgaaattggccatgggtgcttgctaattacctttatccaaaggaaaaacaaattctcatatctttataccaggaggtagttttgcaatgtggagcccgacgcctaggtaacattaggttcctaccctcccatgaaaatgtcaataaaaagagtccaactttgtaacacatttgtagaaatttattctgagccaaatatgagtgaccatggcccatgacacagccctcaggagatcccgagaacatgtgtccaaggtggttgcagcacagcctagttttatacattttagggagacatgagacatcaatcaaatacatttaagatataagttggttcagtccagaaaagtgggacaactcaaagcaagggggtgtccaggttataggtagaatgaaaaatttcggattggcaattgcttgaaagagttttatcatagaaaacaatgtctgggttatgataagaggttgcagagaccaaagttttatcatgaagatgaagcctccatgtcgcaggcttcagagaaaatagattgtacaggtttcttctcagacctaaggcttgtgttgatgttaaatggtgattggcttttcctgaattccaagaggaaagagggcataatgaggcatatctgaccctccctccccattgttgtgggacttttccttagttcagctaaagatgcagtctttgtcccatggccacgaaaatttaggcttgcagacgagttgaagggtgagtaaagcagggttttattgggtgaaaaggaaaaaaaagggggaacagggaccctctgcaaagtcagagtctctgctggtgtgcttcctgccttgcagattgaatcccagtttccacacaggaagaggtggggccaggctcctccctctgcaaacagtgcaaacttctgtggctccaccccaaggtgcattccttccagtgtgggctggttgcagtttcactggggaccctctcccacctggctgtctcaccatcatggcctaaaccagtctttcaggttaaatttagggtgccctggcagaggaggggtccattcagatgtttgtgaggggtgtagggggtggctatgagttttatttttggtttataaagatgaggggatgaggtacaatcctccttggtgattctatctcagagatagttccagacccttgagaaacacattcctacattgtaaaacctgcaagagacttatcttttttctttaaaaaattgctatatccctaagaagcagagaaagaatttatgtttctaaaagaaaatattctgaggaaatggtggtggtggtggtggagatctctttccctttttccatcagggagaattattacttttttcttatgttccatttgtatttactgttacactagttaactaagtatctagccaaaaggaactataatttgagaaggtggttcccatgacttctcctctttcttttctttcagacttctgcttcctcagaaatgccctcattttgtcccaaggtactcagatctgtcactctacttgaatccaatcagcaaaacaacagctctgcagttagctgacttgcttctaacctccatcatctaaagtagaatattaacctcttatatcattattcaaaattgtcacctgggatttcagctcctattctaacaggtcaatagaatcatttcctgaagagaaacaggagtgtgtgtgttttgggagtacggaagatatttctactaagaaaaggagtttttctccacagtgttaacattagaaatctagcacttaccatttcacaaattgaatacctgaggcttagggaggtgaagtgacttccttgaaggagacaagtagcaaatgtggaggttcatgtctgcagcctatagaacccaggaatcctctttccactatgccagactaacctgggaacccaattagctgccatcaaaagtataagaattctttttatttgcctattatctctcatgataagtgaatcaatcacttactgagcacaattcctacaaagtgcaaaatgaccaaagtccccagagtagcttcctctacatcatgagctacaactccagtaaaagagcctggcaactgtcaaagacaaaatgcaccagactgtggagcatatgatttcattaggactatttttaatagagagaacatggcctgatctcagcaggttgtgactgtgtaactggtggtataatttactatcaaaattattctgcaatcaggggggtcttagtcaactcaacaggaaatgtttatctttggattttgttagttcggagggacaaacagttctaatcttagctaattaataatgagacaaagaatgggtggttggaggatctgtgttttgccttgtcagcagacttaggccaaaggggaaaggtctgtgtttgaccttgtcattagcaatgtgctaattgtgactcctaatggggatggagctgggtgtgtgcttggacatggcattccatatgtgcccaggacatgctgtctttttaagagaatataagaatctgaccgggcacggtggctcatgcctgtaatcccagcactttgggaggccgaggtgggcagatcacgaagtcaggagattgagaccatcctggctaatgtggtgaaaccctgtctctactaaaaatacaaaaaaattagccaggcgtggtggcgggtgcctgtagtcccagctactcaggaggctgaggcaggagaatggcatgaacccaggaggcagagcttgcagtgagccaagatcgtgccactgcactccagcctgggcaacagagtgagactccatctcaaaaaaaaaaaaaaaaagagaaaataagaatttaatttcttcagggatcctgagtatctctcattacctaaagtgttcatttattgccaaatgattaactttctatttatgtgtgaggtttgtgggagaccatagagaagttttgtttaaaacatctgtgtatttctttacataattcatttattatatcccttgctgaatgttctggctgagaaagatttaatttaaactttccatcaatgagaacaaagatgaggcttgctgaaatatgttgatgttcactggacagcaaatatcctgctctgttctatattcaaagttgaaaagtgatggaaacctcatcctcatcctcagggctcagaaaagtcacaaggtctttgactttgaagagtggaacaagagggcaacatgttttctagtaagtaaagtaagtgaggctatggagtaggtttcagagtggcaccttcaatcttactcagaaatgtcaaagtctttacaaaggcttcttctagacctgtaagcctagaattaatataaatgctcacctaggtcaaattcaatgatatttatcttaaagggctttcaaatctaagtgagtttcaataaggcaaacccttctgagtcttttatttccctaagcataaaattctatcttctctaccttctgtacttctcagcattagcaaaggaatctcatgataattgaattcaatagtagtttatctgatgccaactattttcccatctctatgctgggccctgggtacacaacaatgaaaacaatgtcctcctctccactacccaggctgccttctcctctaaattgaacaattgtctgtgattcaccaacaacaagaacttttctttacctacctacctaaaatatataaacacaattgacaacttcagacatgttctttcaattggaggacaattacaaatagttgtcctttgtattgatgaaaaggctagtggcaaggttggttgtggcctgggcagcaggctagatgggcctctcaggaggacttgctaggttgcagtgccccagagcaatttatgacataaaatctgtaatatttgagagataattgtcacatctgataatcaagatcaaataactgggttctccttttgtctgcaaatgatgattatgcttgcccacggtgaagctgaccttcgtgtcaaggagctcgatgaggatggaatcccagtgctggctgccagggtgagggtcattttggttgcaggcgagagtgatagaatgttaccaaaaagagaggaaaaacaaactttcaattatgacaagtgcaaaaaaacacattttttattttgaggtttagcatttctcaaaataattacagttacatgcttccatactacgtacttctctctcaaagattagttgtttggatttatctagggcttgaacacaatatcctatcaaccttgtaatcctttacatatcatttgtattgtttttagtcatttagctcagtttccattgaaatgttacctttgttcattattgctacctctaaatgtcctgtccttgtttttatgagaacggtgtgtagctatgttgttacattagaactatataaagagcattaaaagatgtacttatttcacaaattgtcaaaatataaacaaaatataaagcaaaagacaatagagatatataaacatagcccttaagagctgtagatacactcttttttgccaaagatttctatttttattgtagatttggagcgggggtacatgtgcaggtttgctacaaggatgtattgcgtgatgctgaggtttggtcttcaactgaacccatcacccaaatagtgaacatagtacctgataggtagtttttcaccctttgccccttccctcttttctgtccttcagattctctagaatctattgttctcatctttgtgtacatatgtacctaatgtttagcttccacttgtaggtaagaacatgtgatataaatatactcttaaattgttcaaagacaatgaatgcatcaaaaatatttccaaatgccttgcctgagagttttatctgagtgaaaagagttttccttttattaatcccaggttgatatgagctccactttgttctctgtggagtaaaatcctatctctctgaggtttttgtttttaacaattctcattgatttttattgtacatataaaaatgaaatcatttaagaagattcataatgacaagatatctgtagggtaaacccagaaagggttcaagctttatgacagcaaaggaaacagttaacagattgaaaaggcaacctataaaataggagaaaatacttgcaaactatttatctaataaggtgttaatatccaacatatataaggaaaccctacaactgaatcgcctgaaacaaatacccagatttttaaaaggtgtacagtacttggattgacatttctctaaaagaatatctgagtagccaacacacatatgaaaaaatgctcaatgtcactaatcggagaaatgccaatcaaaaccataatgagatatcactccccactggttgtcaaaacaacaacaaaaagataacaagtgttagcaaagatgtggagaaattggaatccttgtactctattgggagtgtaaaatggtgcagccactatagaaaacggtatggaggctcctcaaaaacattaaaaatagaactatcgtatgatccagcaatcccacacttggtatttattcaaaaaattaagatcttgaagacatattcgaactctcatgttcattgcagcagtactcacaatagccaggatgtagaagccgcataaagacccaccgacatatgaatagataaggaaaatgtggcatctacttacaacaaaatattattgtctgacatgaaatccttccatatgtggcaacatggatgaaccctgatgacgttatgctaagcgaaataagccaaaaggaaaatacagtgtgagtccgttattatatgtccaatataaaataaccccattcacagaagcacaaagtgcagtgggttaccaggggctgggagaagtggaaaatagggagttactgtttaacaggtataaagcttcaggtatgcaagatgaataagtcctagagatctgctatgtacaacattgtgcctgtagttaagaacactgtgttgtattcctaaaaatttaagagggtagctctcatgctgtttttatcccaatttttaaaaattagattgcatggaaaagaagatccttgcacatggacttttcctctttccataatttcaaattgcaagcaaattaatctgggatgatgacttatatttctcctccactataattttacttctgcctcaggaggatctcctatgaatttctgataacctagttttcctgtgcttctccgctcacaggttgtcctaaaatcctagttaatttacatgcttgaaattgcttgcatggtttttaaatttcaaataaataatacctttgattggactcatgggcttctgatcaaacccacagactttctttcatcaaaactaaacacttcagtagatcctagaaaaacagtgaaaactctccaagtataaatatgatgctgaataaggtgtttaaaatatatgaagctttacacatacacatacatttttagtatgagggtatctctggcctattcacttaaggaaaaacataccaccagaaatggaattccctttcagtatcagaggttaatatgttaaatcccattgttagctaacatttttctaaaatataccaactagaagtttgtctcataccctactctttactgctcctatcttacacgtatcattatgaaaacaaataaatgtccattttgtttccttttgtaaaaacatatgataatcaaaacatttggtcaacgtctactccatctttttgtttatttaaagacaacttttatgaaatgataatattggaaagttatgatatccttcagctagttgcaaagactaaagaaaatatgctactcaaggtaaatgatttgtaacccctgagcagagtcacagtctccctctctctctctgtctctctctgtctctctctctcacacacacacacacaccacacacacacacacattttagaatcttcaaaaaccacttccaatacaaactaggtacctgaagtaaagagatactcattttggctgaataaaaggcaaattcattttgtgtttttcaacttatttttagagaaagctttgaaatgacattacaagtcatgtcttttgcagccctgtcataaccatgtcactgtactttcagcttctcaattccttggcaagtcacatgcattgtcatgttgaatatcagtattttaaaagaacagctgtcaacatcagtggcatcctgaaaaagatgtacagagaagctcatattacccagaaaaatctcacactgtctttcatacttcagaaataaaaagggaaaaggaaaggtaattgccctttaaacatacatttatatagatgccagagaaaccaaataaaataggaagctatttttcaactgacatgttctaagtcaatataatggcattacatattttctcaatttgtttaatttgattttaaaagtcacaaacatttgaatctacgggtatgaatttcattcacattatatataatgtaaaatatttactttcatgattttaaaaatcttgtctattttgtgtagttttcttttgaaaatgtaatgtgttttctcacatcttgttaatgtacttctaaaaattcatttaccgagtacacaatgcgtaagcatcaaattacatctaaataatctgttgattggacagtttctcctcatacactacagaacaattaggcacaatagaaaaaatctctatgtcaaatataagtgattttaaaagtgattattaatcataataacataagaacaattggagcagggccttcaatattgtcacatttatgacagtacagttatctttgtgttacgagtatcttaaataagaacagtaaggttttattttatatgagaactatttttacaatttagctaattataaaaagtttgctttgagatatagtctagattattttggtatgttcttttctctttttcattttggctagtattactgttagattgtaacagcaatatttatcctccatggcatataacatctgccatttcagtcttccgaagtgatgttgttggggttcagaacacaatactccaacagatggcacctcggcctgctgaatactttgaactaaaggagattggaggcttcagaatcaagggcaaggtcgctgaccttctcctaccctcctgtctccctcccctctcattactctgaagctgaaaccagaattccttttccccaaggcaactcacagaaactagagcccctcttccccaaagcaagtcataaaacctagaaaagtcattcttttccttctcccttgaagactgtgtgtcccacagcaggagaaataaatgcagcttagaggccaggaagacaggtcttgctgggttctttctcagcctattaccatgagatcattcctttttgtccaatcacatttccacatggctgtcccttcttcatgaagcctacctataaaaatagatgatttccctgggtctttggttcttcatttttgaaagctcttctgatatgtaaaactttgattaaattgatttgctatacttttctttaaactgccttttgttataggagtactggttgtgacctttctgatggggaactttggaaaggtatcacccctttctgcccttactgtataaagagtaaacaggtagttgagacacagaacaatatcataaaatttcttttgtcctttagacaaggccttggctttttctccattgcgattttgatggactgcaaataaaaatggaaccttatttcatatattttaacataagactggccgggcgcggtggctcacgcctgtaatcccagcactttgggaggccgaggtgggcggatcacgaggtcaggagatcgagaccatcctggctaacatggtgaaaccctgtctctactaaaaatacaaaaaattagccgggcgtgatggcgggctcctgtagtcccagctactcgggaggctgaggcaggagaatggcgtgaacccgggaggtggagcttgcagtgagcggagatcgcgccactgcactccagcttgggcgacagagcgagactctgtctcaaaaacaaaaacaaaacaaaacaaaacaaaacaaaaaaacaaaaaaaacacataagactatccaaccatttctagactaaaagcagtgatcatgaagcagattctgctaatcggctgtttctatttcattagaattttttgcatggttaactgagattgtaactgtaattttattttttgtatttaatcttttaaaagtaatttagctttaatgttgtactcatttcataaaatgaattagaaagcttttatcagttttcaattcttcggaacagtatagactgcactggaattaacttctctttaaaggagcgatacaattctcttagaaagtagtggccacctaatattctgaaggactgacatttttctttgtcttttgcatggaagtcagtcaatttagacttttctaatttttataggattcattttgttaaattatattttcttggaaaatcatatactttattaagattatcaaactaatttgaataactaagctaaatagattcttacaattcttttaatttcctcattagctcttcttttttctgtttttgttttgttttgttttgttttgtttgtttgtttgttttgagatggagtctccctcttgtcacccaggctggagtaccgtggcccgatcttggctcactgcgacctccacctcctgggttcaagcgactctcctgcctcagcctcccgagtagctggaattacaggcacccgccaccacgcccagctaatttttgtatttttagtagagatggggtttcatcatgttggccaagctggtctcgaactcctgacctcaggtgatccgccctcctcagcctcccaaagtgctgggattacagtcatgagccactgcgcccggcccggcctggaaatcttatctaaaaagtagcaactgctggaaaaagggcctggggcctggggggcgggggtggttcttgtcacagcccccaggctcctgtctcagggatgaatgtggccttctcactgggattcttctcttgtccaaaagggctgcttttggggactaacaatactggggagtgggggtgaagccagacctagctcagggtgaggatttcggggccctggcgtactgaacacaccccacaccccaacattctcctccttctatctcttcctcttctcccgaccgcttttgtgccggggctgcgagctccctgtgttgtgcggtgactaaatcgaggccgagaagggaggctgccccccaaccctgtgggtcagtgcccctctgccaggctaggagaaagtgggtttacagcagccgagctgggggttattttggctggagctgctggagcagaaaggcaggagtctgaaatgctcggcagggtctggggaccttgttggacccgcctggtgaccggctgggctgtcgcgtcctacacgggagctccgggctttcatttctcttgtggtggggtggggattaactcagctattcccatggtaagcctgggtctctaattgggccctgggagccctgttaggccaccggcattgggggtcggtgaggaaggggactccccaactcccccgactcccaaccgccccacctccgcatagccttggagacccctgggggagggggctggggggcttctgagcccctgagtctaggttcactctcccgtcgggctgtgggaggggactttcacttgcctttgtctttggggacgggaccccactttcttctgatctcagggccattgacacacaccccctttccaggaggggttggtgggcagctaggttctccctgccccttcccggggccggcaccgtagcagcacaatcaccccgggaagggggtgtcttttcgctccaagacgcaatcgggccccactcgcagaaccgcctggaccctgtccgtgtctgccctccggcccccagggctcctctccccagagccgccgtcccgcgcctgggtcccgcgctgggggaagcgcctgctgcttatctctgtctacctcaggtctgacttttgatgccaaaatctaagcccctggggtgcctctcccccgcctcccgtgcaccagggtctgcagcagccactggggccaggctgcctgctgcatctggcggccctggaggcggccatgggcccctttgcacccgcccgccttggtgtctggggaggggctgcgcagggccgtgggctgggtcgtctctctcgggctgcgtgtgttgcgctcccgtgtgcacgtgtgtgtgtcgggaatcctgcgtgtcgtgcctgtgtgggcgatccggccccctggctgtgggtgggactggattctaactcaggggacttgggcctgctgttaacttcgatgattgtagggacaggtggggcgggcggtgggtgggcacggggctgggtcctgggcggcctggcgactccaggagaaggaaatcactgaaggcagtggtcgtggaaatgggagggggtcgcagggggtctgtggggcccggtcctggatactgggcaggaagccgtggtctccagagggtactccctgcctcaggtggccccattcaaccccagccgtacgcacctcccgccactgcctgtcggtgggggtttaaagttggggtggctttctggggtgcagctcagcatcccctcttatgcagactgggatggggtcgggcacctccctcagccacgaggaccctggacgggttcgagttctcttggggccgtggggctagctgtgtactgggcggggaccccacactcgaggccaagggggggctctccctgctgtgagatgttgggggacaggcagcttctggaaccttcagtgggacccttaagtggccgtcaggacaggcgggaggatgggcatggggcactggggagagccggggtcgttaagggtcacgcatctgtacagtctgaatttcctttatctttttttttttttacccactttgtccctcttttcccctaattgtgctcttgcattttttttttcttggcaaacgtaaactcagcctttcattcatgacgtgtgacatttcagtttctctggggtttgtcagaggacgcggggaccacgcctgaaagttaggtaatgggagaaaaaaaataatagactttaaaaaaataaaaaataaaagaatcataaaactactctctacctctggctgggcccagcctttcttgccctggccgcagcagggtggcctgtaacaatttcagttttgcagaacatccaggtattgaaaggaaaaaaaataaaaaaagacaaaaagaccagaaaaaaggtgtgattttgaaatttaaaagaacactgaaagtttacattttataatagcattattatgcagattgtattttaacttcagaaatatttaagacgattgtaaccctgtaaagctgataagatattaaaacgagacaaaacacttcttttaacaggaaaaaaaaaaagaaatttcttctgtcagataacctaaatcatctctctcaagttcaaagttccacaaatctctagggcaggggcaaaatgctgccagtctctttgctaaaacataacaagagtcacttttgctccagttcccaacaagttgctcatctccatctgagaccacctcagcctggcccttattgttcatatcactatcagctttttttgtcaaagccattcaacaaatctctgggaagtttcaaactttcccacattttcctgtcttcttctgagccctctaaactgttccaacctctgccttttacccagttccaaaattgcttctgcatttttgggtgtcttttcagcagcactccactctactggtaccaatttactgtattagtctgttttcacgctgcttataaagacatacccaagactgggcaatttacaaaagaaaggtttattggacttaacagtttcatgtggctgggaaagccttgcaaccctggcagaaggcaaggaggagcaagtcacgtcttacgtggatggcagcaggcaaaaagacagagagcttgtgctttattttaatttttgttgtgcatatatgtgtatgtatgtatttatttttttttattttaagttctgggatacatgtgcagaacatggagtttcgttacataggtatacatgtctcatgatgttttgcttcacctatcaacctgtcatctaggtttttaagccctgcatgcattaggtatttattctaatgctctccctcccctttcccccaaccacgacaggccctggtgtgtgatgttcccctccctgtgtccatgaggaactcctctttttaaaaccatcagatagtgtaagacttattcactatcacgataacagcctgggaaagatttgcccccatgattcaattacctcccaccaggtctctcccacaaaatatgggaattcaagatgagatttcggtggggacacagccaaaccatatcaagtccctagagtgagtaggtgggtggagcttataattactggattggaagctcatcaatatcttttaagatttatatgccataatttgtccagcatctgagtactttgtagcatgaaatgcttcatgttacaatgaagtattagtctcacatattataggcgctgtcttcattttctgttgctgcataatgaattaccacaaattctgctgcttaaaataatacgaatctattatctcacagttttagttgcctgggcacaacaatttaggtgttgtctgaggtaacttagggtttctgagtcatattcctcattttcttctgtctttcttccactgcctaattatgaagccactcctagtctcaattataaaatctgtctttgttttctgttgctgtactgccaattactacaaatttagcaggttccaactaagccatttataaattcatagttttgtaggatagaaatctggtgtggtgaggccagttgcagtggctcacacctgtaatcctagcaatttgggaggccaaggcgggtggatctcctgaggtcaggagttcaagaccagcctggccaaagtggtgaaaccctatctctactaaaaatacaaaaatcagctgggcgtggtggcgggtgcctgtaatcccaggtacttgggaggctgaggtaggagaattgcatgaacccaggaggcggaggttgcagtgagctgagatcgtgccattgcactccagcctgggcaacaagagtgaaactctgtctcaaaaaaaaaaaaaaagaaagaaagaaaaaaaaaagaaatctggtgtcgcttgcttgggttctctgctcatcatctcacaaatctgaaatcaaactgctgtgggctgttttcatctggaggactgagcaaggaagaatctgcttccagcttatcagcacaattgagagaatccaattccttgtggttgtaggactgggatcctgtttgctcactggctgtccactgaggccactgtcacatcctagaggatactgtattccttcaaaactgcaatagcatgtcaaattcttcttgtgttttgaatctctgacttccttttttgacatcagctggagaaaattttctgctttgtaaggactcatatgattagaaaaatctccccatgttagggtccatccagataatctccttatcaatgaatcaggaccttaattacatctgcaaaatctctccacagcagtatctatatcagtgtttgaaaaactgggagtaggtgtgtatacaatagggtaaaaaatattggccatgggcagtgggaggaggtatcttataattctgtctactataaacaagttgtttcctaaaattttctcttgagttgatttaatactatattattttattttgaggggggcaaaagatatataaagtattacaaatattaatttactcaatgtaaatttggagtgccattaattgttcctcatggcctaaaaggcttaaagccctgataataatctcattataataaacaactttgcaatacactgaattggtccactgacctttgtttcaattcatatgtcttcaaaaattcatccctcaatgtaaacaatcataatagtctcgacagtccagaaaaatggtgtaaatggtgtacaaacttcaagaagagctgtgtgtgtctttgtgtgtgtttgtgtgtgatcacaaaacctagatatatgttaacatgaaatattatggaagaaaattaatttaaggaagtgaggtggaaatgcaaacacagaaaccaaaagatggaactgtccccacaaattttagaaatagattgtgttctaaacatcaaataaaatcaagccatagaaaggaagaaaatcttaaatacacaagtaaaatttgctgtttttctctcagtctctatttattttgttttccacatgctttaagttgatcattgtttcctttactcagcaatgcagaagagatgagtgataggaagaaattaccatggcaaatcatgaatagactgataacagctagtgactactttgcaagtagttatttgaaactacttgcaaagtagaccgggtaaaaatttatataacaaaatgcaaaaattgagtaattaaccgctgagttataagaatttgacttaaccctgataattcctgttgaacaaggacattgcgtgttcttctattaattccttaatcatgacttgtaggttgaaaatgagaaatgcttcttcttgatagataaagcacagatcttatagcaacaagaggaaagaactatgggccaaattttcttagctatgcttgaagtaaactttgacaactaatcactttttattttatttaagaattcccaaccaggagtaaaagtccaaacctgacttataaggcatataatttaaaaaataatactgtgaaataacttaatacaaataacaaaatgttgaaggtaggcatgttaaatccacactatcagattgggttttaaagagaaggagaggagacatcaagcatttagaaatcaataggaaaaagattgttctatttttataccataatgcaaaggaggcagagtgattttaagaacactgaagttaaaagcaattaacttggtaaaataaaatataggtaggtagataatcagatatatgtaaaaacaaacttcaaaaattattttaacatcataattttagataaattgaatcagtggcttattcttgaaggtatagtagcaaatgagatgactgttaagtaactatcaaacaactttttgtttgacatagttgaagtcagtaccatctgtgtgcaagagacaccgttcctatcacacagatagcatgggaaacacctgcctgcatgattcaattacctcacaccaggtccctcccacaacaagtagaaattcaagatgagatttgggtgggtgtgagaaatctactcatccatccaaacccaaagaatggacttagaggcatgaagaacagcgaaagtgagacttaataatggtcttgcaagattgggtgtctggtaggtaggtacatctggggcagtcacaacaagtaatttatcttccagtacgcaagtccctccccaagttcctcattggttgagtgctatggggttacaattttcctggatgtcacctaagtttcattatcccccttataaggttatatcccggtcctctttcttgcttgtttcaatttcccaataatgaaacttttttcccttttatgggctaacccctccttttcattgtttgcttactgtgaccttctaggtgcatgagcagtgcggtttgttaaatttgcaggctggcttccagtacttttgatttatcatgccttgaaaatggaccatttaaaatggtttctcataaattccctcctcttttctatttacttccttcggtcttctttttatttaagcccttttggtctttgaatcactggggacacagccaaaccatatcagcatttaaacactgtttccttattatgtaatctggataataaaactcgctctttctatattatgccacataaaatggaagtatagatgtgacactgtcattaaatctgtgaattatatgtcattatgtttctaaaacacataaatcgtagtgaagttattccatctcagagacggcccatttaactataataaacttctaggtattcattatatagtgtattttttatcatcaaatcactgatcagatattttccttaatgatttattcttccatttgacaaatagattttggggcaagttctttgttaggtgttggcgtgatagcagtgaagaaaattcagcactcggggaccctgctgtctaattgggaagagcacatcgggggacacacagacatgggaacgtgcagggtttttagaactgagagacccaattgaggctctcagcaaagtcatttttcaggaagtggcatttaagctgagacctaaatgatgatttgtagtttgccaggaaagaaatccagagagggggaggggagaccacataagcaaagaccttgtgtcaggaaagaactttataccagagacgaatggaggatgagagtggaagtcagaaaggcaggggctaggcccggtgcggtggctcacgcctgtaatcctagcactttgggaggccgaggcgggcagatcacaaggtcatgagatcgagaccatcctggctaacgtggtgaaaccccgtctctactaaaaatacaaaaaaattagccgggcgtagtggtgggcgcctgtagtcccagctactcgggagactgagggaggagaatggcgtgaacccgggaggcggagcttgcagtgagccgagatggcgccactgcactccagcttgggtgacagagcgagactccatctcacaaaaaaaaaaaaaaaaaaaaaaaaaggcgggggctaagtcactgaggcctgaggctgcacagggagctggatggtgtctttggaggaaacgaagacaaagaggttcaaagctgcttaaaggtcttgcaggaaagtgataaagtcagatttgcatcttttgaaaggtcatgttagcatcttttaaaaggtcatttataggagtctgccccagtactgcactgcatatgccacattgattaatggcaaacaccacttgggccctatttcttgcacatcgaacttgtaatacagcatgctctgtcatgatggggacagtacgagatagttcattatgggaagacatgagaacctcctttatcttgaacatgagatggagatgtggagatgtcaggaaaattaacagaaagcaagcgacttctttactgagatctggagaatgaaaagaatcaggtagtaaggaaatgataggtgggtgtaaagggaatgtggcaggtgtctgaggtggtgtgggcagagcccatgaagctagaaaaatcattcttgttcagagcgaaaattgattcagtgtttctgaatagttgaatattctgctccatgaactgcttccgagtctggaaggggcatggaatatgagatgacattgaagatcaactcgggcataaagaatttgggatttaatccacaggcaaggaggagctcttacagtatctgaggggcacatttaagagcaagacagattatttttcagagaatctgctgtacattttggaaggatacccctgactgcagtgtgattccaacatgaagggacttgaggcaggtggcgtacataggatgcagaaacttatgccaaggatgatggcaccctaagcaagatgccagccatccagacagagaaaagtgggcacactcaaaatgtattaagaatgtggcatccacagggcttagagtgccactgagcgtcaacagtctggaatatgtgttttagcaactgataggatgttgctgtcaagatagggggcgctagagaataagacagctttggacgagaacaaaggaggtaatactggtttcaaatagactgagtattgcacgcctgtaatccgggcactttgggaggccgagggtgggggtagatcacctgacgtcaggagttcgagaccagcctggccaatatggtgaaaccccgtctctactaaaaatacaaaaattagccaagcacggaggcagctcacctgtaatcccagctactctgaggctgaggcaggagaatcgctagaacccaggagacagaagttgcaaaggttgcagtgagccaagattgtgtcactgcactccagcctgggtgattccgtctcaaacaaacaaacaaatagactgagtattaatggtccgtggctcatgcaagtggaggtgtctggttagcagtttgatatgaaagactgagctccagagagatctcataacttgggaatatgttttactccatacatattcaggtaagactaaagatcctgggattttggagtcatgggggaaagtgatattattcctgagcacttgctaggaactatccccaggttgcctcaggaccagcccctctcgctacagtaaccccataaagcagtgcctacactttacattttacgggttcgaaaccagctcagtgggacttagttaaccgcccacagtcaagtgtcagcatcaaaactggagtctcacccaaagccagctgaccccaaagctcacactcctgtaagatgtaattgctcaagagatcttagacctcacctgatccaatctcttttctttccccgctgagacggagtcttgctctgtcacccaggctggagtgcagtggcgtgatcttggctcactgcaacctccacctcccgggttcaagcgattctcctgccttggcctcccgagtagctggggctacaggtgtgtgccaccacacctggctaatttttttttttttgtatttttagtacagacggggtttcaccgtgttagccaggatggtctcagtctcccgaccttgtgatctgtccgcctcggcctcccaaagcgttgggattactggtgtgagccaccgtgcccggcctcctcgttttctttaacagatgtttttggttaaaactcctgagttgatttgttttcattactcaaagcataatacagcaacgataattaagaacaaaggctccagagccttacaaagctccctgctcactgaacgtgggctctgggtgaaaccccttaacctcattgtgcctgagtttcctcatctggaaaattatgagttctcacttcagagagatgcactgagtgtgcatgcacaataagtgctgttttatttttattaatgtacatatttgtagaccacaaatgcatttttataaaagtttcaaacaatgtctaagtttagctaataaatttctctaaacacacctgtgttgtctggctgcattctagcatcaatggaatattactttatgcattattatctgacttcctttcttctctcatgtcatttctgtcttggtgatctctccgtgtcacgccgtagctaggtttctctcctactttctcacagctgcaccctgctagatagcaaggattcagaatgatttttctatccctcactgataacattctagagagttgtcaggtttttagaaattattattacaaacagtgccgcagtaaacattctactacatattagggggatgttttgtccttatttgagaatttctgtaagaaaaatgcctatgttctaacaccggatgtaaaacatatacatagattacgctagagcaagaggttcatatactgagtgtttctaaaatattttttgatttaatagtttattactttcattgtataactgtacatgctccaagtacattctacaggaaaatctcaaacacttcaggaaagcagtaaacattaccataatgtgataaaattggtattttattaattttaaattatatttctaacacataagccatattacccttgacaaggtactctcgttaggagtcagacaaatttatgaatgtgtgcaatctctattctatttctgtctaggactatatttctttaaaaactagtagctcacattcttaggaaactaagatagagaaaagaatagaggttttcaagttggaagatcttaatcagtgtggtttttaaagtttcaccttattaagttgaatgaacaatgggagatcacagtatcaattattcaaaagtgattaatgcaggttaaatgccaacaggctggaagagcacgtaaatgcatcgctaacctcttagcaactataaagatttgtttgtttacatatttcaccatatggatatcattgaactcttcagccttataatggatattttgtgaataaaatattattttgcaagaaataaaaaatagtgtttgtcttttagcattgcacggttgaggctacatttactcaatagttcaaaacaggtaatttagtgctaggaatatcatctcccctgagcatagctgcaatatgctctatacacagggaactatctgttttaagatttggtataatggggcccggctcagtggctcacgcctgtgatcccagcactttgggaggctgaggtgggcggatcacctgaggtcaggattttgagaccatcctggccaacattgtaacaccccatctctactaaaaatacaaaaaattagccgggcatagtggggcacgcctgtagtctcagctacttgggagaccaaagcaggtgaatcgcttgaacctgggaggcggaagttgcagtgagccgagaatgtgccactgcactccagcctgggcaacacagtgagactctgtctcaataaacaaacaaacaaacaaacaaagaataaattaaaaagatttcatataatggggcagctgcttttaactggaatgcaataaatcctcacatactttcgaaagactgactttggtgagatagcatgctaggcatagagagacagggacctcactttcaggactgtcacaactcagtgcctgacacaggcatgtaggcaaacctcatgctgggaagttcagaaaagggaggaaagaacgtgtggcgaaggaggccaggaaacactccatcttacagctctgtaaatcagaggtctgccacagtctttctgggctaacgtctgtgcgtcagtcggactatcatagactcaacattctttaaagacctgaaattgcaaattattttatttcctggagcaaaaccaggtgcccatcacccatccatcacccaacacacatacacttcttttgcaaattgctacagttacaacaaagttgtggtcaatttgcagtaacaattaaagatgtccataggtgtgaagagctgaggtaaggaaagtcacattctccttatatgagcctgactcacaaaggacttactgtgaaggaaggtgagagagtcctggagaggctacatgagattgctgagccctttcagaacccacttctcaggcattgctggttgcatgaggttacagtttattggacctgccccattacctggtggagcgacctgtgcatctcttcgaatctcccagaaagagatttgggctcatggggcctgagggcctgagaggctgctccataagagctcagtcttcgcaactcacttcaggcgctactatggacactatggagcacttctttttttgttgctgttgagttttgctctgtcacccaggctgcagtgcagtggtgcaacctcagctcactgcaacctccacctcctgggttcaagcgattctcgtgcctcagcctcctgagtagctgggattacaggcatatgccaccacacccagctaattttcatttgtttttttttttatttgtttgtttttttgagacggagtcttgctctgtcgcccaggctggagtgcagtggcgtgatctcgggtctctgcaagctctgcctctccggttcacaccattctcctgcctcagcctcccgagtagctgggactacagatgcctgtcaccaagcccggctaattcttttttgtatttttagtagagacggggtttcaccatgttagccaggatggtctcaatctcctgacctcacgatccacctgcctcggcctcccatagtgctgggattacaggcgtgagccatcgcgcctggccaattttcatacttttagcagagatggggtttcactgtgttggccaggctggtcttgaactcctgacctcaggtgatctgcccacctcggcctcccaaagtgctgcaattacaggcatgagccaccatgcccaggcactatggagcacttctaaggacttttgggctttggagaataccaacctagcagaaatggttccttttggaaaggacattggatgacatcaaatgctcagcataaagtatatgctttgggtacctgtcactcttctaggtgaccctcatgaaaattgtatgaggaagttattgtggagaagcgatgaggcagggtcatagagagaacagggactaagagggtgcaagaagttggggaagttgcagagctaggtgacagaggagcagagcagaagaaaaagcctcggtgttgggagaaaacatgaagaaaaaataagttttgtgcttggtcctatgatatgaactgcctgatgctggtggcatgagggaaggttgctttagctataaaggtacaacatccatcaatattccacagtactccacattgcctttctccaagcactctccagagaaacagacaccactcatcagtgggagaaaactgaaccattttgtagaagaatctccaattataaagagtaaatgaatggatcctttttatacctcagactcctgaccacattgcatctcgacaatgatgcaccttgtcatcattgtcatgtgacagtttttgaatctggtgtttttctttctgcaatagtaaggccaatcctgcagggaccgaagtctgtgcaatcactgtgaaacacagctggaaataaggcaggaagaacttacagagctcaaacgtgcccatcagaatattttgaaacataagttacagtataggaattctcccctaaagtctccaaactggagtgagaacagctgaattactttcataatacaaaaacattcacagaatctctatgaaattatgaaaattaaattctaaggtgcattttcataaatgaggtggttgctgtgtttattttctgttgctgcaaattttgccacagactcactggcttaaaatgatgtgcatttattatgtcatatgtctcccgatccgtgggagtctgcctggggtctcgtgaggttggattcaagatgttgcctggatacattctcatcttggaggctcggccagggaaagagctgcttccaagacccctcaggttatcagcagaatttgtttccttgtgattgtataactcagtacgcaccatcttcctagctgccagctgcggacccctctcagcttccagagattcctctcaaggcctccccacgcggcctgtcatctcagcagcagagaaactctcgcatcttcaactctctcaggcttctcacctctctgacttcttcaaagctctgattaagtcaggtgcacctctgattaagtcaatgcattcaaataatatccctatcttagggacaattgtgccatacaaatgacctaattacaggagtcaaacacattatattcatggttcccggggttaggcagtgtttgtatgccaggtggatgggatatcgccttgggagcgccatctttagaatcctgcctaccacaaatcccaattctataacacaaaaggcctgagggcttcagcactatcacagcaggaggtataagtttcccagatacccaaaggtatccgctgtctgtctccacctaacatcccatgttcataccaggtggtgaaaaatccactcgtcatccataccattcagaagcatacagcctggattttgtcattctagttcttgtcactgtgtgtttgagcacatactagctagagaagctctttcatcatcagctctacacagtgcaatcctcaaaatgcccaccgttatccagaggttaccaatctctctcttttaattacacttaaactagcagaaatcttcttcatatcattaacccaaatggagaaaagaaagctagaaaattatacatctatttttccaccaaaagaaaagaaaaagaacattttcctcccacatttattgtgccttcaagtggttatagcaacctgttaagatcagccagtgtcgttaaactgcttcccagcgaatacagccagtgaagctgaaagagataataaagtttcttaggagaccgactactacactggcttgacacttgctccatacagaagaaaaaataaatcagtagttacacctccagcagctactgactagacatccttgcgttaagggtggaaattcaatatacaaagaagcaaagtgttgacaataaaaagaaagtaaaaactgaaagaaaattgtaattggattgaatgtggctaaaatcaagatatgaaaaagcagaaaacaaagccaattcaaactctgaagaaagaataaatgagaaaataaatgaaaaaaattaattggctcagcaagtcatgactagaaaaaattaacattattaaattattctaccttcgggcatggaataaaatgaagatgtaagtattcatgttaatttcagtctatttctgaatggtaaattgctttctccttcttcctctttgtatgtttaggtctgggaaatttgtttggaattagcaacctgggatgaggtttattaagacagaatgactatgagcttgcctgcaaagtggccgctcctttcttcccttcttttccatcaggtcattcgcccactgagaggtggtatctatttctgtacccccatgaatctgcatttgcagattccaagattaggacataagaagctttttagcttttgcctgggtctcgtggaatgcaggggaatctggggaaagccaagctctctacaaaaactctgactagcccaagactgtcatactgtgaggaacctcaagcttgtcacatggagaggctgtgtggagaccaagttacctgaccagctcctagctcttcaatccatagcattccaggtgccaggtatagaggtgcagaagctttctgacagcttcagccttgtctgccatctgaggtgccacaagtgagaactaatctggagtaatcaacatcaccatcccctgccatgaaatcaatgcagtgtgttcattcactaaattaggaggcagcttgttctatgcagtggtacagaacaggaacaatgatgcttagggctggggtatgggttgtgagggaagaaattccatgtcagcaaaacttcagagcatactacatcttctgtttgtttgtttgtttgtttgtttttgagacagagtcttgctctgtcacccaggctggagtgcagtggcacaatcctgactcactgcaagctctgcctcctgggttcatgccattctcctgcctcctgagtagctgggactacaggtgccagccaccacgcccagctaattttttgtatttttagtagagacggggtttcaccatgttagccaggatggtctcgatctcctgacctcgtgatccgcccacctcggcctcccaaagtgctgggattacaggcatgagccactgtgcctggcgagcatatgaaatcttaaaggtcacgcagctgaatttctgagcttacgaaaaggaaaccaggtactcaaagaagctgtgacctgccaaaagtcacccagcaaattaatagtggaaccaaagtaaaaatcaaattttcagcatgtaatgtccttacaccacgtaaaaaaggtttgggttccttagtttgagaaacgtcaataccccttcataaatcaagggtataaactttgcagaaaaattaaacttcttaccacctggcatccaaactggagtgagaacagctttgccacatctacattcccactcctactcagaagacagactccaagaagcataaaacttctggagtcctggggtaacctgagcaaaacccgtgataggtttccaggaagcaagggcgtgagcaggggtggagactgaagccccatccctgcaagggtccactctgaacctcaaggcccataatcctcccccatatttctctgctctgccatttttgggtgctctgtcaagtcccaaacccctcagtaagtctgtcttttcttctactctaagcacctctattcttctagctcaccctttcactgtggtcctgccttccagctctttccttctgtgccctctgggaactcattacattttcaaaaaggactatctcaacatcatcacagaatgcccttgtatagcatagcgtttgagagtatggcttggaagcaacagtctggatttctaatgcagactccaccatttaccagtcacaaaccttaacaagtcacttaatgtctctgaacttcagtatcttccactgtaaaatgaaggtatccattgtgaagattaaataagatgatgcccataaaatgcacaggctaatgcctggcacacacaaaaaataataaaacaacaaaaaaagggttgactatacatcctcaactccactgaagcctagaccaccattttcaatgcccttgtagaactcattacttccatagtttgtctaccatagcatcaggaaacatttctggtaaatttccatcaattcctggtcactggtgttcataaaaagcagcaagtaggctaggcgccgtggctcaagcctgcaatcccagcactttgggaggccgaggcgggcggatcatgaggtcaggagattgagaccatcctggctaacacggtgaaaccccgtctctactaaaaatacaaaaaaaaaaattagccaggcttggtggcgggcgcctgtagtcccagctactcaggaggctgatgcaggagaatggcgtgaacctgggaggcggagcttgcagtgagccgagatcgggccactgcactccagcctgggcgatgcagcaagactcagtctcaaaaaaaaaaaaaaaaaaaaaagcaagcaagcaaacaaaatgacaatctcacttatccttttagacaaatatcagctgattacagcaacctctaccatttctagcaagtgtcatcttccaaatgggtcattttcttacatccatcaccatcttctcaattcctcaatcttcaatttccttgtagatgacacttaagtgctaggaacttgcaattccttcatgtgtaaatgatcttcactgttgctccttttcagcacccatgccatggacgtacttggaacttctcatgacctaggatggtaccatctttttttttttgagacggagtctcactctgtcacccaggctggagtgcagtggcgcaatctaggctcactgcaagctccgcctcccgggttctcgccattctcctgcctcagcctcctgagtagctgggactacagacgcccaccaccacgcccggctaatttttttttttgtatttttagtagagacggggtttcaccgcgttatccaggatggtctcgatctcttgacctcgtgatcagcctgccttgacctcacaaagtgctggaattactggcgtgagccaccgtgcccagccaggatggtactatctttaaggattttttttttttttttagacggagtctagctctgttgccaggctggagtgcagtggtgtgatctcggctcactgcaacctccgcctactgggttcacgccattctcctgcctcagcctaccaagtagctgggactacagacgcccgccaccacgcccggctaattttttgtatttttagtagagacggggtttcactgtgttagccaggatggtctcgatctcctgaccttgtgatccgcccacctcggcctcccaaagtgctgggattacaggcttgagccactgcacctggccgcatactttttaaaataataaattatccaatactatctaactatggagactatcattgggttcattcataagatatagtgaccttaaccccattcattcaaaccatatcagattctctttttttagtgcattgaaacattattctttgccaaccttctgtattgataaacatcaggatggcaccaaaaatctaaaatatgcaattctataaaatgtggcagttgtaaatgtgaatttggtgggaacttaatacctgaaccattatttcctcagttggcaaagtgaagttgtttcctcttctttatgagattgcagcagaaacatgcaatttaaaaagcaagagagaattagggatcactcaggcccaactcgattccaccataaccctcatttttcaaccaaagtaaaagaatctcatgcatgttgcgtgactagctgttggagatgttcttgttaggaccccttcatgagtagtaccatgtcttctggctctcggcctgctgctctgtccacatgacatagaagagtcacaacaaggtgacagacagtcacaagtgctgcaaaatcattgaacaaatgaacaactgtgggttccttttcagttactagcaaaacataggtgcaaaactaaaattgttatatttatatttataccattaataaatgttataaggttataaacatcatacaatgtatgagggattcctgtcatctttcttataaacccactgtatagatgctttcccgcacatgctgttctatcagagacccttttcctgtttctgcctgccttcttgatctcatccaaaaggtcagaagagtctggctctcacctgcaggttcagggaagccccagtagcacactcatggctttctactctctcctattctccactgcaacttaaagatccttcacatcttacctcaagacaacaactccatggtcacggcaaagcattaagtataactactatatattttttacaaatatactttaaattatctcatatcaatgaaaagaaacacatatatggagtaaaaaaaaaaaaagtcattcacttcacaccactggctctctcacttggggatcagggaacactaatttcttgaagatccttccagaaataatcctgtacctttatatgcatgtatatgtataaatcttatttggaaatttcaactgagaacatattttggggttcccacgactacatcatggtcatgatttgctcagtgattcaccggaaggactcatgtaagtcaaaaagttatgcttacagctaagatatattactgcaaaggatactgtgcaggaactgtgagacacatattttgcatgcataagcaaagactagagaggtcaggcccaggtttccacgttccttctctcgcgagaattgtgcagacacgccctttctggctgcaaactgtggagatgtgtggcaggcatctccacctcagaaagtccgctcattagtgaccagcctgcccaacatggtgaaatcccgtctcttctaaacatacaaaaaattagccgggcgtgatgacgggcacctgtaatcccagctactagggaggctgaggcaggagaattgcttgaatccgggaggctgagcttgcagtgagccgagattgcgccattgcactccagcctgggcgaccagagcgaaactctgtctcaaacaaacaacaaaaaaagtccactcaaatctcagaatccagagttcttaaaggctgctgatcacacagctacccaaccagccaagttgcagatgccaaacaggcaccaggtacacatcattaattttcatgtttaaacaatgctgtcagcccagtacatcctgacccactgcctgggccatagagaatacaatcttaatcactgaccaagcgaacattcctgtcgttagttctcttcctgtggctccaagctttcccagagattaaaaagagctgagtaaaacaaacctactgtagtcactttttatgcacggagcacaatatgcacactattctgtattttgcctttttaaaaagcaatatatattaacgttatcagtaaatatgaccttattttttcatggctgcttgttattctggggcatggaggcactattatttgcttagtcagccacctattgctggagaactggacctgtactatttcactgttataaaaattgatacaattaacatctccatttagcgggggatatgagtatttctcataagaatcaccatttagaaaagaatgaatatggccggtcttggtggctcatgcctgtaatcctagcactttgggaggccaaagcaggcggatcacaaggtcaggagttcaagaccagcctggccaatatggtgaaactaaaaaaaaaaaataaaaaaaaaaaatagccgggcatggtggcaggcgcctgtagtcccagctactcaggaggctgaagcaagagaatcgcttgaaccagggaagtggaggttgcagtgagccaagattgcaccactgtactccagcctgggtgacaagcaagactccatctcaaaaaaaaaaaaaaaaaaaaagaagaaaagaaaagaatgaatatgaaagtggacttatagtaacccaccagcctccttgtggattgccttcttccactcagaaaagttgccatttatttatttgtatgacattgccaattatccctcttgtgttatttttaaaattttcccaccagccgtctaaatgactgtcacctactccccacaccctaaggcagcaatttctgatttggaaccatgggaatttcactttcacaatttcatctgccaacatgcaataacatctgtctctatgctgatgtggttgttcatctgggcctgggtttaaatctctgtaccaccttaactagcaaagtgacattatgcaactgacaatctcttgtgatttttctgtgaattaattgaatatttacgtgtaacacaccaagtgttctgcaaatgctagctttactggtttatttagtattctaatttaaattgataaaattctttttatgattgtcttctgctaagcagtaatatttaaggctgatgtgtgatttatatattattccaagacatataactacaagaaatatgcttttcctatccataattttaaaagcactgtgttaatcaacagaatattattaaatatttggacagtatcagtttgaaaagttaagtgaagttatatctcattgctgtgaccctttttttgtggtacgttcttcaaggtaaaaacaaaatatgtatcaatcaaatgaaacactgttttgttctgaatgttaaatttgctttgagtaattgcttattgtttttcttctaaaataccatattcccaggatgttctaggaacttctgtttggcaaaagtaaaatccttatcacatgaagaacctgcacggtaggaaagaaaattatcttacagtttaagttgtcagtgaatttgaatagtaatgcccaacttgaactcatgagaagtagttaaccttttcaattagagttctgatgagtttttaatataagcaataaatccctaattattattatagaaagcacaaattagggaaaaattacagtcctcaaagacatggctaaatctaaactcttaggtgcctggaaattatttactaatagaagtaattagagaagaaacctggtgctttgttccactacagcgatagctgctgggaagagggcacctcttggatgcatagacatcagggagcagtgtctggagctgggttctttttttctgagatggagtcttgctctgttgcccaggctggagtgcagtggtatgatctccgctcactgcaacctctgcctccagggttgaagcgattctcctgcctcagcctcctgactagctgggattacaggtgcctgcctgccagcacactcagctagtttttgtatttttagtagagagggggtttcactgtgttggccaggctggtctggaactcctgactgcaggtgattcacctgtctctgcctcccaaagtgctgggattacaggtgtgagccaccgcgcctggcctggagctgggttcttaaggcccatccaattgcagggataggcagtaggtcagggtggcacatgaacacagtttggaaaagtctacacaatttcagatggctgaaagttgaagtaaaaggccgaaattaaaccagtctattccacagaataaatgttcttgttgatatttgaagtgcacccaagaagtacagagttgcaaatgattcactaaatttacttcattctgctccaagtacctaagggtacaaggaattggaatcttctgccttcctttttagggggcagatgagaaataagagaaagggaagcctctgagaacagggaggtagaagggagagcaaagggtctgttgtaaggggtgtgggagagacagcagatttggaagcagggtacatccagccctctctggccttcttggatgagcctctctcctcccatctttgggactacaatggggattacctcgtttttgtttttttgaagaaagcatggttacatttgtcttatatattttttaatttgtatgaatttatgggtaacaagtgcaattttgttacatgcatagtggtcaaggcagaacttttagggtatctatcacccaaatgctgtagattgtacccattagtaatttctcatcatccccccacaattctgagtccccactgcctatcattccactgtctacatccatgcagacactttttttagcactcacttatgagcgacatctttctatatctggcttatttcgcttaagataatgacctccagttccaaccatgttgctgcaaaatacatgatttcattctttttgtggctgaatagaattctatcaggtatatataccacatgttctttatccagtcatccactggtggacccttaggttgattccatatcttttctattgtgaatagtgctgcaagaaacatgagtgtaggtacctctttgatatattgatttattttcctttgagtagatacccagtagtaaggttgtgggatcgaacagtcgttctagttttagttctttgggaaatctctattttcaataaaggttgtactaatttacattcccatcaacagcatacaaacattcctttttctccatatcctcaccaacatagcagatgagacattttatctttttaataatagccattttaatgaagatgatatcttattatggttttaatttacatttctctgatgattagtgttgagcattttttttatatgcccatgctggccatttgtgtgtcttcttttgaaaaatgtctatttatatcctttgaccacttttaaagaacattatttgttctttttcttttttttttttaatttttttttttagacagagtttccctctgtcgccaaggctggagtgcaatgtggagtgcagtggtgcaactttggctcactgcaacctccacctcccagattcaagggattcttgcctctcagcctcccgaatagctgggattacatgtgcccaccaccatgcccggctaatttttgtagttttagtagaaacgggctatcgctatgttggccaggcgggtctcaaactctttaagtggtccagtcctcctggcctctgaaagtgctgggattataaacgtgagccaccatgcctggccttgtttgcgctttttgttgttgttgagggagttgtttgagcttcttctatattatggatattagtcccctatgggataaatagttttcaaatattttctcctgtgcattgtctgtttacacacctggttatttcttttgctgtgcagaagctttttagtttaattgtcccatttgtctaattttggttttgttccctgtccttttaggtcttaagtcataaattctttgcctagaccaatgtccagaagaattttctcaaggtttttagtattttgatagttttgggtcttatatttaagtctttaatacatcttaagttgatttttgcatatggtgagagataaaggtctgtgtccagatttggttcctgccagtgggttggtggtctcgctgacttcaagaatgaagtcacagaccttcacggtgagtgttacagcttttaaaggtggcacggacccaaagagtgagcagcagcaagattcactgtgaaaagcgaaagaacacagcttccacacatggaaggtaacccaagcagattgccactgccagctgaggtggccagcttttattcccttatttgtccctgcccatgtttggtttttgtcctatcagagtgcccttttttcaatcctccctgtgattggctacttttagctactgctgattggtgcattttacagagcactgattggtgcattttacagagcgttgattggtgcattttataatcctcttgctagctacagagcactgattggtgcattttacgatcctcttttaagacagaaaagttctccaaatccccactcgacccaggaagtccagctggcttcacctctcaggttctgttttattttcctgcatatggctatctaatttcccagcaccgtttattgaaaaggatgtcctttcttcagtgtctcttcctgttagttttgtcaaagaccagttggctgtaactatgtcgtgttatttctgggttctgtattttgttttattgatctatgtgtctgtttttacagaagtattacactgttttggttaccatagccttgtaacataatttcatatcaggtaacgtgatgcctccagttttgttctttttgcttagaattgattttgctatttgggctcttttttctggttccataaggatttaacattgttttttctaattctgtgaaaaatgacattggtattttgatagggattgcatttcatctatagattgctttgggcattatggtcttttttttttttttttgagatggagtcttgctctgttgcccaggcgtgatctcagctcactgcaagctccgtctctcaggttcatgccattctcctgcctcagcctcccaagtagctgggactacaggtgcccgccaccacacctggctaatttttttttttttttgtatttttagagacggggtttcactgtgttagccaggatggtcttgatctcctgacctcatgatctgcctgcctcagcctcccaaagtgggtcattttaacaatattaatttttctgatccataagcatggaatatttttccattcgtttgtctcactgacagtttctttcatcagtgttttatagttttccttgtagagatgtttcacctccttgcttaaatgtattcctaggtagtttattttttgtagctcttgtaaataagatttccttctcagctagtttgttattggtgtatagaaatgctactgatttttgtatattacttttgtatcaattttactaaataaacttactaaattcatttatcaaatccaagagtgttttggtggagtctctaggtttttctagacaggtaatcctatcatcagcaaatggaaataatttgattttctcttttcctatttgaatgtcttttaattctttctcttacctgattgctgtggctaggacttctaatactatatcaaataggagtggtgaaagtgggaatacttgttttgttccagttcttgagaaaatgctttcaacctttcccccattcagtatgatgttggttgtgggtttgtcatataagccttttattatttgaggtatgttacttccatgtcaagttatttgagggttttttttttatcatgaagggatgctgaattttatcaaatgatttttctgcatctattgaggtttttaatccttcattctattttcgtgatgtatcacatttattaatttgcatatgttgaactatccttccattccttatgtacaacccacttgatcattgtgtattacctttttgatgtgctcttgaattccatttgctagtattttgttgaggatttttgtgtctatgtttatcagagatattggcatgtagttttctttttttgttttgttttgtctttgtctggttttagtatcagagtgatactggccttgttacatgaggaatgaagaagtccctcctcccagattatttggaacagtttcaggaagattggtattagttctttgtacattttatggaattcagctatgaatccatcaggtcctggactttttttttccatgggaaatttatttattactgattcaatcctgctactcattattggtctattctggttttcagtttcttccttcttcaatcttaggaggttgtatgtttccaggaatttagccatttcctggggatttttttggtttgtgagcatgtagttgttcataatagtcacagatgaaattttgtttttctgtggtatcacttgtaagtcttcttttcatttctgattttgtctcttctcttttcttggttgctagcagtttatcaattttgtttctcttttcaaagaaccaactttttgtttcattgctcctttgaatggtattcttacatagatgcaatgataatatgtcctataggctttagaagaatcttagtgcattgtcaaagaaacatttttagttgagcacatacattatgagcaaaggagtggcattagatcttcatagtagaaacagttatagtgtttctaatacatgtgtttcttagagagaatctaacaacattgaaagggcctactcacaaaggccactgtgcaaagataacaggaaactccccaaaagcttatcttcaagttagctgcatcaagtcctgtggtgcttgaaaatctctccattaatgctgaattgaagactacagggagatgaaaagactgtaggattaatatgcttcatcacgataatctataatattaagaaataatttaaaattgttgaacaaatatgtcatggtgtatgtcccaaaggttcattatgggctattgaattaataactttataaatctattcacatatcacctaagacataaaattattttgaaaagaaacagtggaatttgatatacaaacattttagaactcgaattgccttgtaaagatgtccacatatgattgggaaagaaggcagaccttcccagagggagtgagtaaagcatcatcagcaaataataagttaaacaaagtgaataaaagcttattgttaggtatgtaatgtttgtgacaatattgtaggaaatattgtacataaaatgctgtatggagtataaactcagatgtaacaggatcatatttgaaaatagtaaatatgtttaatattcttcttcttagtaaatcatgttccctagccatcattttaccttattgcaataccaatccaaaaagaggagaataagaggccatgtagttccacatcagcccagaaaaggcgtcccctctttctggtcatgacagattatgagaatgaaaaggggatgaaggcagaaagttcaggaggtgagacacgtatctaaactcctctatcagagctaaagtcccagaagtcaagtcttcttagctacactgaggaacaagtgaagaagagatgatgactttaatttagcttcctacttgagtttttgaagggagatcacttagcagggtacttgtggtagcctgttcaacaaatgtttccggttcttttccctttcaggtacacagcataattgtaattcctgtccacttgaggtagggtggaactatgtaactaattctgcccaatgacttgtgagtggaagtggaagcatttgattaccagagtgagaccattcagagctcttcttttccctctggcacagagtttttcacatgtctttcaagacaacacatatattagctgagaatatgggtacaaattaacagaggaaatgatcaggaagtcaattgagtctgtagtcaagggcagaaatgctactcaatgccagcaatcaggtaggccttacaatcagagtttggagtgcctatagcatcagcagaaatgatgtggcactcatcagcaaagggcgatgtacttgtttctgggagtatggcctataccaactgaatggccagtgggacgtagcaaccacagactttggaagtggtgttaaagaaaacacctgtgattaagtatagattaactataccttagtgatgtcatctaaggactgaaggacctgaccagtggagaccaacacagatactcatatgtcccaagaaactctctccacccacccaatgccatgaatttacatgagccctcatatgcccaaattccaccttggaaaacattagcgagaggacatgaaaatctggaagacaacacttactggaaaagatctcatctaaaataggctattcaacccgttagagattaggccactgacttacatttgggtttttccaaatctaggcaaatacttctgtattagttttgactaaaaatggaattacaagcaggtagtcatttcctataacatctccaatactagaggttgttgacgatactgaaaagaaaaatgattaattcattttcatgacattttctaggctctaaagcagggatcttaaaaatcagagcagccaaatgcttctactctgtaggattaatctatggcaacatcttaatgagtcttttgcttatctggtgcctatcttcacacatgttgacacctatacatattgggtaaattatgatatgataaagctaaaagtgctgatcataggtaatgataaatatcatttgcacaaacagcttaattcactcagaattgacatacctgactccttagccatatttaccattgatgctgttatgtttgactgcagatatcagattcatttgacattcaaaatgtcatttaatacaactcagaggaaagggtgaaataaaaataaagggtctattggctctcatatttctagtaactattagaagaagtagtaaacagaagttcatatctcatggctacaagcagaatgtttccctgtacagtcatacaactttatcaatgctgtattccaaatgcttttttattagatttgagtcactgcacttaagatctgggaacactgaccagctccatctggctggcctttgtatctgtgaacaaagtagagaaatacagaagggttatagtttctttggggggggaagctgagaaaaaagggtcactattatgaagcttgagcctaaactttttggatatattaacattaaatacaacatgtatcagtaaacatttagattttataaattatatattttaataatttttattatgtatttatttgaaaaaatcagttttataccatattctattttgagatattgcattctaataaatagtggtgagttcatatggctaaaagtgtcataaagaaatgcttaggggtgaactttcctattgtaagtattttccttgtattttgtaatctgattttaagctatggttatcggttgtgcactaataatggtatttctcaaaggaagaaatagtataatataaaaagtatttcataaagtgctcaattaattttttttttttgttgttgttgttgtttgtttgtttgtttgttttttgagacggagtgtctctctgtcgcccaggctggagtgtagtggcgcgatctcggctcactgcaagctctgcctccagggttcacgccattctcctgcctcagcctctggagtagctgggactacaggcacccgccagcacacccggctaattttttgtatttttggtagagacggggttttaccatgttaaccaggatagtctcgatcttctgacctcgtgatccgcccgcctcggcctcccttgtgttgtttgtttgtttgtttgtttgtgacggagtctcgctctgtcggccaggctggagtgcagtggcgcgatctcggctcactgcaagccccacctcccgggttcacgccattctcctgcctcagcctcccaagtagctgggactacaggcgctgccaccacgcccggctaattttttgtatttttagtagagacagggtttcaccgtgttagccaggacggtctccatctcctgacctcatgatccgcctgtctccgcctctcaaagtgctagaattacagaccgtgcctggactctcctaggtttattggtatttgtcttttccctctgtcttcacatggtctttcctttgtgtgtgtctgtgtcctaatctcttcaatatgacaccactcatattagcttcatatccatctctatgacctcattttaccttgattacttctttaaacgttctttcttcagatatcacattatgaggtactgggggtcaggacttcaacctgtgaattttagagatacacagttcggcccacaacataaatgaacctcgaaaacattatgctaagtgaaataaatgagacataaaaggagagatattgtatgattacacttacatgagatacatgaatagtcaaattcagagacaaaaagtagaagaatggttaccaagtcctggggaaagggttggaggaatgcggagttattgtttaatgtgcagttttgggatgacacgaaagttctgaaggtggatagttatgataattgcacaataatgtgaatacacttaatgccactgaattgaatatttaaaaatcgtcaaaaagataaattttatgttatgcatattttaccacaataagaaagaaaactctagaaataaaaatatagtaacagaaatgaagaatgcctagcaatgcattggagagggaataaatggtatcaaaattaaatcttttatttttcttattcttaatatgtgtaaagcataacatttaaaaataatagtattacaatgtattgcatgattatcaaatatgaataagtgcgattaatgatagcagtattacaagggacatgagagagaagttgagaatattctgtatgaggtacctatactgtacacaaagtaatataatgacatctgaaagtggactgagagtacagaatcatatattgtaaactgtagagcaacaattaaaaaccttttaaagagaagtataattactattctaagaaaggaaataaaatggaatcatataaaatgatcaattaaaaagaagacagaaaaagagtaggaaataacaaacagcaaattcaatgagcagaaaacaatgacaaacatagtagatatcactccacctatatcaataatcacttcaattatgaatggtttaaaaatgctattgtaactgtactccatttgcttaagaaggtagatgaaaagctatatacattaaggagagacatggaagatacaaacactaaaataaaacttctaaaggtaaaaatacaatatctgatataaaaattcattggattagattaacagcagattaaacattgcaaaggaaaagattcatgaataaaaatcatagcaactgaaactatacaacatgtcacacacagatttaaaaaaagactgaaaatgatgaagagggaatctgtaagctagataaactgcaagcagcttaatatatgtaagattggagttcccaaaaagtagtaaagaggagaataataaaaatgagggccaggtgcagtggctcacacctgtaatcccagcactttgggaggctgaggtgggcggatcatttgaggtcaggagttcaagaccagcctggccaacatggtgaaaccctgtctctaataaaaatacagaaattagctgggcgtagtagtgggggcctgtaataccagctacttgggaggctgaggcataagaattgcttgaacctgtgaggtggagattatagtgagctgagattgtgctaattcaactctagcctgggcaatacagcgagactcagtctcaaaaaacaaacaaaaaaaaacaacaacgaatatttgagtacacaatggctgaatatttacaaatttcatggtaactacaaattcacaattccaaaaatctcaataaactcaaacatgaaaaaattacaaggcacattaaagtcagattgtttaagactactgatggacagcgttaaatgcatccagatgtggagcacatgagatacaaactaacaaagaatgagaaaagaatgaaagcatattcctcattgaaagaaatgcaatcaagaaaacaagtatagcttttctaaaatacggaaataaaataaaagtactgaaatagttctatagtatttgtactcagggaaatcagattttcacaaatgaaggcaaaataaagagcttttcagacatgcaaaagctaaaagaaatcagtagcagaaccatatcacaaagaaatgctaatggaaattcttcaggcggaaggaaatgacacccagtgaaatctacctctattcaaaggaatgaaaagcatcagaaattatagctacatgagcaaatatttgtttcttattatgtaaatttcttttttattattactattatttttaaattatagtttcagttctggggtacatgtgcacaacatgcaggtttcttaacatatgtatacatgtgccatgttggtgtgctgcacccattaacttgtcatttacattaggtatatctcctaatgctctccctcccctctccccccaccccacaacaggccccagtgtgtgatgggggcctgtgtccaagtgttctcattgttcaactcccacctatgagtgagaacatgcggtgcttggttttctgtccttgcgatagtttgctcagaatgatggtttccagcttcatccatgtccctacaaaggacatgaactgatccttttttatggctgcatagaattccatggtgtgtatgtgccacattttcttaatccagtctatcatttttggacatttcggttggttccaagtctttgctattgtgaatagtgccacaataaacatacgtgtgcatgtgtcttcataccagcatgatttataatcctttgggtatatacctagtaatgggatggctgggtcaaatggtatttccagttctagatccttgaggaatcgccacactgtcttccacaatggttgaactagtttacagtcccaccaacagtgtaaaagtgttcctatttctccacatcctctccagcacctgttgtgtcctgactttttaatgattgccattctaactggtgtgagatggtgtctcattgtggttttgatttgcatttctctgatggccagtgatggtgagcattttttcatgtgtctgttggctgcataaaagtcttatttgagaagtgtctgttcatatcctttgcccactttttgatgagattgtttgattctttcttgtaaatttaagttctttgtagattctggatattagccctttgtcagatgagtagattgtaaaaattttctcccattctgtaggttgcctgttcactctgatggtagtttcttttgctgtgcagaagctctttagtttaattagatcccatttgtcaattttggcttttgttgccattgcttttggtattttagtcatgaagtccttgcccatgtctatggcctgaatggtattgcctaggttttcctctagggtttttatggttttaggcctaacatttaagtctttaatccatcttgaattaatttttgtataaggtgtaaggaagggatctactttcagctttctacatatggctagccagttttcccagtaccatttattaaatagggaatcctttccccatttcttgtttttgtcagatttgtcaaagatcagattgctgcagatgtgtggtattatttctgagggctctgctctgttccattggtctccatctctgttttggtaccagtaccatgctgttttggttactgttgccttgtagtatagtttgaagtcaggtggtgtgatgcctccagctttgttctttgggcttaggattgtcttggcaatgcaggctcttttttggttccatatgaactttaaagtagttttttccaattctgtgaagaaagtcattggtagctcgatggggaaggcattgaatctataaattaccttgggcactatggccattttcacgatattgattattcctacccatgagcatggaatgttcttccatttgtttgtgtcctcttttattttgttgaacagtggtttgtagttctccttgaagaggtccttcacatcccttgtaagttggattcctaggtattctattctctttgaagcaattgtgaatgggagttcactcatgatttggctctctgtttgtctgttattggtgtataggaatgcttgtgatttttggacattgattttgtatcctgagactttgctgaagttgcttatcagcttaaggagatttggggctgagatgatggggtattctaaatatacaatcatgtcatctgcagacagggaaaattggacttcctcttttcctaattgaataccctttatttctttctcctgcctgattgccctggccagaacttccaacactatgttgaataggagtggtgagagagggcatccctgtcttgtgccagtttttgcccattcagtatgatattggctgtgtgtttgtcataaatagctcttattattttgagatacatcccatcaatcctagtttattgagagtttttagcatgaagggctgttgaattttgtcgaaggccttttctgcatctattgagataatcatgtggtttttgtctttggttctgtttatatgatgaattaaatttattgatttgtatatgttgaaccagccttgcatcccagggttgaagcccacttgatcatggtggataagctttttgatgtgctgctggatttggtttgccagtattttattgaggatttttgcaatgatgttcatcagggatattggtctaaaattctctttttttgttacgtctctgcgaggctttggtgtcaggatgatgctggcctcataaaatgagttagggaggattccctctttttctattgattagaatagtttctgaaggaatggtaccagctcctctttgtacctctggtagaatttggctgtgaatccatctggtcctggactttttttggttggtaggctattaattattgcctcaattttagagcctgttattggtctattcagggatccaacttcttcctggttcagtcttgggagggtgtatgtgtccaggaatttatccatttcttctagattttctagtttatttgcatagaggtgtttatagtattctctgatggtagtttgtatttctgtgggatcagtggtgatatcccctttatcattttttattgcatctattggattcttctctcttttcttctttattagtcttgctagcggtctattttgttaatcttttcaaaaaaccagctcttggattctttgattttttgaagggttttttgtgtgtctatttccttcagttctgctctgatcttagttatttcttgccttctgctagcttttgaatgtgtttcttgttgcttttctagttttttttaattgtggtgttagggtatcaattttagatctttactgctttctcttgtgggcacttaatgctataaatttccctctccacactgctttaaatgtgtcccagagattctggtatgttgtatctttgttctcactggtttcaaggaacatctttatttctgccttcattttgttatgtacccagtagtcattcaggagcaggttgttcagtttccatgtagttgagcagttttgactgagtttcttaatcctgagttctagtttgattgcactatggtctgaaagacagtttgttataacttctgttcttttacatttgctgaggagtgcttcacttccaagtatgtggtcaattttgtaataagtgtgatgtggtgctgagaagaatgtatattctattgatttggggtggagagttctgtagatgtctattatgtctgcttggtgcagagctgagttcaattcctggatatctttattaactttcagtctcgttgacagaaagtttctgtcaattcctggatatccttgttaactttctgtctcgttgacagtgggttgttaaagtgtcccattattattgtgtgggagtctaagtctctttctaggtctctaaggacttgctttatgaatctgggtgctcctgtattgggtgcatatatatttaggttaattagctcttcttgttgaattgatccctttacattatgtaatggccttctctgtctcttttgatctttgttgatttaaaatctgttttttcagcgactaggattgcaacccctgcttttttttgttttccatttgcttggtagatcttcctccatccctttattttgagcctatgtgtatctctgcacatgagatgggtctcctgaatacagcacactaatgggtcttgactctttatccaatttgcccctctgtgtcttttaattggagcatttagcccatttacatttaaggttaatattgttatgtgtgaatttgatcatgtcattatgatgttagctggttattttgctcattagttgatgcagtttcttcctagcctcgatggtctttacaatttggcatgtttttgcagtggctgatactggttgttcctttccatgtttagtgcttccttcaggagctcttgtaaggcaaacctggtggtgtcaaaatctctcagcatttgtttgtctgtaaaggattttatttctccttcagttatgaagcttagtttggctggacatgaaattctgggttgaaaattcttttctttaagaatgttgaatattggcccccattctcttctgccttgtagagtttctgctgggagatctgctgttagtctgatgggcttccctttttgcataacccgacctttctctctggctgcccttcacattttttccttcatttcaactttggtgaatctgacaattacatgtcttggagttgctcttctcgaggagtatctttgtggcattctctgtatttcctgaatttgcatattggcctgccttgctagattggggaagttctcctggataatatcctgcagagtgttttccaacttggttccattctccccgtcactttcaggtacaccaatcagatgtagatttggtcttttcacatagtcccatattatttggaggctttgttcatttgtttttacttttttctctaaacttctcttctcacttcatttcattcatttgatcttcaatcactgataccctttctttcacttgattgagtcagctactgaagcttgtgcatgcatcacatagttctcatgtcatggttttcagctccatctggtcattgaaggtcttctctatgctgtttattcaagttagccattcatctcatcttttttcaaggtttttagcttctttgatatgggtttgaatatcctcctttagcttggagaagtttgttattactgatcgattgcagaatggcaaatgttgctgcctgatccttcctctggaagcttcatctcagaggggtactaggctgtatgaggtgtcagtcggcccctactgggaggtgtctcccagttaggctactcgggggtcagggacccacttgaggaggcagtctgtccattctcagatctccagctccatactgggagaaccactactctcttgaaagctgtcagacggggacatttaagtctgcagaagtttctgctgccttttgttcagctatgctctgcccctagaggtgcagtctacagaggcaggcaggcctccttgatctgcagtgggctccacccagttcgagcttcctggccactttgtttacgtactcaagcctcagcaatggcagacacccctcccccagccttgctgccaccttgcagtttgatctcagactgctgtgctagcagcgagcaaggctccatgggcgtaggaccctccaagccaggcacaggatataatctcctgctgtgccatttgctaaggccattggaaaagcacagtattagggttggagtgtcctgattttccaggtactgtcagggctacccttgactaggaaagggaattccccagccccttcttcttcccaggtgaggcaatgccccgccctgctttggctcatgctccatgggctgcacccactgtccaacaagccccattgagatgaacctggtacctcagatggaaatgcagaaatcactcatcttctgtgtcactcacgctgggagctgtagactggagctcttcctatttggccatcttggaacctcccctcatgtaaatttcttttaaagataattgattaaacagaatgataacaatgtgttgttattgcaacatatgtatatacaaataaagtatatgacaacaaagcataaagactgagaggggagaaatgcaagtatactgttgtaaggtttgaatagtatatgtgaaatggtataattcacttgaagctagattgtgataagtttaagatatatactactactccacagcaaacacaaaattagcaaaataaagaattataattttaagccaaaaaataccagagacaagtctcaatcaattcagaagtttatttagccaaggttaaggacatacccgtgacatagccttaggaggtcctgagaacatttgcccaaggtgatctggctacagcttgaatttccatgttttagggaggtataagacatgaatcagtacatgtaagacatacactggttaggtctggaaaggtggggtgtattagggttctctagagggacaggactaataggataaatgtatatgtgaaagggagtttattaaggagtatacactgtcacaaggtgaagtcccaaaataggccatctgcaagctgaggagcaaggaagccagtctgaattcccaaatctcaaaaatagggaagccgacagtgcagccttcagtctgtggctgaaggcccaagagcccctgccaaaccactggtgtaagtccaaaagtccaaaagccaaagaacttggagtccaatgttcaaagccaggaagcatacagcatgggagaaaatgaaggccagaacactcagccagtctagtccttccacattctcctgcctgctttattttagctgtgctggcagctgattagatggtgcccacccagattgagggtgggtctgcctcttctagtccactgattcaaatgtcagtcttctttggcaacaccctcacacatacacccaggaacaacactttgcacccttcattccaatcaagttgacactcaatattaaccatcacatggagtaatgtgaagggggaggaaggggcagtgggggggttgtggactgcaagtcataagtggattaaaagatttcctgattggcaatgggttgaaagcttttatctaaagacctggaattaatagaagggttaaaataaggggctgtggagaccaaggtttttattatgcagataaagcctccaggtagcaggcttcagaaagaatagattgtaaatgttttttatcagacttaaaaaggtaccaaactcagttaattctctcccggatcaggaagaagacctggaaataaaaggagattttctatagaaggtagattttcccacaagagacagctttgcagggccatttcaaaatatgtttaagaaatatagccaggcacgttggctcatgcctataatcctagcactttgggaggctgaagcaggcagatcacttgaggtcaggagtttgagaccaacctggccaacatggcaaaaccacgtctctacaaaaaatacaaaaaaataagccaggaatggtggcgggcacctgtaatcccagctattcaagaggctgaggcaggagaatcacttgaacctgggagacggaggttgtggtgactgagccaagatcatgccactgcactccagcctgggcaacagagggagactccatctcaaaaaaaaaaaaaaaaaaaaaaaaaaagaagaagagggagagaaaagaaatatcttttgaggtaaaatatttttatttcttttagggcttgctgtctgtcatgttggtatcttaatggctaccaagagtctgtttcatcagtcgtaaggtctctgttttaatgttaaatgctggtcagctgtgcctgaattccaaaggaaggtgagtatagtgtggcgtgtctgacctctactacccatcatggcctgaactgattttccaggttaacttaggaatgcccttgtttgagaggaggggtccattcaattggttgatgggcttagaattttacttttgatttacatagttaatgaaccagaaaggaagatgaaatgtaataaaaatgtttgatccaaatggaaaaaaagaagaaaaaagaacaaaaatcaaaattatcgactcaaacctaactatataaataatcatattaaatgtaaatggtttaaacacctcaattaaaagtcaggaattgtcatataatttttttaggaagacccaattctatgctgcttacaagaaatacactttatatataaagaaacaaagaggttaaaaaatacataccatgttaacagaaatcaacagaaagctgataaatctagccagactaatcaggcattagaagaaaaaaatgccagtagcaggaatgagaaaggtgacatgattttaggttttacagatgttaaaagaatcataataaaatattatatataacttcatgtcaatgatttccacaattgtcataaaatagatgaactccttgaaatacacaaactaccatatctcactcaagaagaaatacataatctgaatagccctacatctgttagagaaatacaatttgtagttacaaaaccttcacataaagaaaatgccaggcccaagtggtttcactagtgaattatatcaaatatttaagaagtaatactaattttacatgaactcttcatagaaaatttttgagaaggtaattatttcctacctcattctatgaaattagcattaccctgatataaatgtcaaagacattacaagaaaagtaaactagagacaatatctctcatgacattagttgaaaaaatgcaattttagcaattaaattacagcattatgtaaacagaataacacacaaggaccaagggggcttatcctaagaatgtgaaattgtttgaacatttaaaaatcaaacagtgtactaagaagaaggaagacaaaaacagaaatgaaaaagacattgcaactgatgtcacagaaatccaaagatcataagaaactgctgtgagaaaaaatacaccaataaactcgataacctagaataaatggataaattcctagaaacatacaacctaccaagagtgcatcatgaaagaaataggaaatttaaacaggcaaacagtaaataaggagatcgaatcagtaataaaaaaaactcccaacaaagcaaagcctccgacctgatgactctgctgctgaagtctaccaaatatttaaagaagaattaataccaatcattttaaaactcttcccaaaaaatcaaaaaggagggaatatttccaaactcatttcacgaggccagcattatgtgaatttaaagacagacaaagacactacaaaaagaaaactacaggtcgatgtccctgattaatatagatgcaaggatcctcaacaaaataattgcaaaccaaatttaacagcaaattaataggatcatacaccaagtgggatttatccctgagttgcagggatggttcaacatgtgaaaatcaattaatgtgatacagttaatagaataaaagataaaaatcacaaaatcatctcaatagatttaaaaataataatttgataaaattcgacactttttcatgttagaaactctcaacaaactaggaagagatggaagttacctcaacatattgaggccagatatgaaaatcccacagctaacaccacactcagagtaaaaaactaaaagcttttcctctaatatcaggaaaaagacagggatgttcacttttaccacttctattcaacatagtaatgaaagtcctgcccagaatgattattcaagatcaatacaaaaaatacatcaagttcagaaggaagaagtgaaattgtacctgtttaaacatgatctaatatacagaaaactctaaagactccacaaaaaactgttagaattaataagtcaattcagcaaagtagtatgataaaaaacaatatgtaaaaatcaattgcatttctatacaccaaaaataaactctctgaaagaaaattaggaaaccaatcccatttacaacattatcaaaaataatcaaatacttaggaataaacttagccaaggaggtaaaagacacactgcaaactgcaaaacattaatttaagaaatttaaaaggacacaagtaaatggaaagacatactgtgttcatagattggaagtcttaatatctacactactcaaagcaatctacaaattcaattcaatatccataaaaatcctaatagcatttttacagacagagaaaaaacaattctaagattcatatataattggaaagtaccctgaatagccaaaacaatcttgagaagaaagagcaaggctagaggcatcacttcctaatttcaaaatatattgcaaagctatagtaattaaaataatatgttaacagcataaagatagacatttaagaccaatgggttagaatagggagccaagaaatagatctgtgtatatacagtcaattgatctttgacatgggtgccaagaatgcacaatcaggaaaggacagtctcttcaacaaatgctgctgggaaaactggatatctccatgcaagagtagaactggatccttgtcttataccataaacaaaaattaaatcaaaatggattaaaaacttaaatgcaaggtgagactgtaaagcttctataacaaaacactgggaaaaagattaatttccaaaatacgttaggaactcaaacaactcagtagataaaactaacaatctgattttttaaatgagcaaaggacttgaatagacatttttccaaagaagagaaatacccacaggtatatgaaaagatgctcagtgttactaatcatcagaaaaatgtaaatcaaaaccacaatgaaatatttcctcacacctgtcaggatgattattattaaaaaaaaaaaaagacaagtgttggaagggatgtggagaaatggaacctgtgtacattgtttgtgggaatacacgatggtgcatttactatgggaaaaaagtacgaacggtcttcaaaaagttaaaaacagagccattatattgctccaataatcccacttctgagtatttatccaaaagaattgaaatcaggatcttgaagtaatattaccattcctatgttcattgcaacactattcgtaatagctcagatgtagaaacaacattaatgtccattaacagataaattcataaagcaaatgtggtatagacatacaatggaaataatattcagcattaaaaaagaaattctgcaatatgcacaacatgaataaaccttgaggatattattccaagtgaaataagccaatcacagaaagacaaatcccgtataatttgcttattttagatagtgaaaatattaacagtacaattcatagaatcaaagagtggaatggtggttgccaggatgggagtgaaagggaagtgaggagttgcttatcaatgggtataaaatttcattaatgcaagatgaattagctttagagatctgctgtgtaatactgtgcctatagttaacaatattttattgtatactgaaaaatctcataagagagtagatctcatgttatattcttaccacaataaaataaaaattttaaaaatcaagcactgtagttcaccaaatagagaaattaaaaaagaaaagatcttatctcagtataatcagaagaaaataactctcagcaaactggcactagcaggaaacttcttcaacctgattaaggtaatttacaaaaaacctacaggtaatgtcacgcttagtgagttttctcacattttttcaacatttccagaaagatggttgactttgctgggttttctttccttttcttaacctataagaacaatctctgtaacctgcatcctttgcccacgaatgaactctgacttcctgaaactctaagtgagcaacttggttgttacttctggaggtatcagccttctgctaattgcatttaagatgccattgtagaaagttttggccacaggacctggctggaaaacactggccccactggactgtactctgtactcaaactttccttaagtataaagatttgatagagaatggcttttacataggaagatcctggggatggttaagcacatgagaaatgattattggggttctctgagaaagaaaattgtcagaagaggcaattgaatcaccgagatctacgaactaatgtagaataagtcactgcaagcatcagcttagtttctctccaaatgagaaagcagtcgtcaaactccttcacatatccttgaaacatacgaacaatctgggcatctgttgtctacacaggggttgcttctcttgaattctctaaacataatttggtacaatagagtattagtcttttgcatttgtgtgtgtgtgtgtgtgtctgtgtgtatacacacacagacatacacacatatgccatacaatattttttgaagttttattaagtttaataattgaatgactaatactgcagctatgtctagcatattgtgttagaaaacatgcttagcctctctgtaagagagagccccagagaactgggaacgtttatctatgtagaaccatatatctagtagaaccatagaacatttatctatgtaggctgaatgtgcgatttatcatattctcaacaataatcctatgcttggtgaaatgtataagggacctttgcgtacctttttttctttttgcaacttcatgtgaatctacaattatttcaaaataaaaaaatttaaaaagtacatgtgtcaaaagaaatctcttgataaacataaaacaataaaaaaggaacctttgtcagaaacacatggataggctctctgtgattgtctctcatggctgttgcttaacttgaataaaaattcacatcatgtcaaatattacaagcaacattatctgtgacatagtctattgaagcagtcacattggcattggggagatacacaaacaaagcaaaccatagccatctggtattctcagcttgtttacaaaatcacttaacaaggctaagttgaagatgtggaaatagaggttcatctgggagtgaatggtctcacctgtccccgacttacttttctctctctccatttccctcagggctcaatgaagagggagtcatgaagaatttggatgagcaagtgccccagtcctatgtatttatgtctccccactgatgtacagtgctccatctgccataaatatctatcgactcaattctgagtcatttactggacttctattttttttcctttgggctatttcatctatcaggagatttgccccatgctgtcttgaaggctaacattatgaattttgattggtggtacggcagttccttacatcttattattattatttttattctacagatttgttttcaattcttcggcctttgactttttttgtacgaaggtaagaattattaatagttgtttaaatactcaaaaaacacagtgaaaatttttaggggaaatgcactgaatatatctatcaatttgaaaatggaggctgggtgcagtggctcacgcctgtaatcccagcactttgggaggcaaaggcaggcagatcacgaggtcaggagattcagaccatcctggctaatatggtgaaaccccgtctctactaaaaataaaaaaaattagccgggcgcggtggcgggcgcctgtagtcccagctactggggaggctgaggcaggagaatggcgtgaacccgggaggcggagcttgcagtgagccgagatcgtgccacagcactccagcctgggcgacagagtgagactccgtcttaaaaaaaaagaaaagaaaatggaaaagcttaaaatcatgagttatatagtattatcttacatattactatatacataattcagtgaattatagtattcaagaatatagaatgaattttcatttagttttataaatttccatgtttcttgatcttattgagcattcaaggcaatcaataaaatatactcctgatactagaaattccttatattttctggatattttttgtggcatctgtacattgcaaatactttctaccagtctgaagattggttgtcactttgttaggttttctttaagatgttttttctttctggccgggcgcggtggctcacgcctgtaatcccagcattttggaaggccaaggcgggcggatcactaggtcaggagatcgagaccatcctggctaacacggtgaaaccccctctctactaaaaatacaaaaaattagccgggcgtggtggcaggtacctgtagtaccagctactcaagaggctgaggcaggagaatggcgtgaacccggggtctgagcttgcagtgaacctagattgcgccactgcagtccagcctgggtgacagagcgagactctattcaaaaaaaaaaaaaagagatttttttcttttcaatgtggaagagttaaattatcttttcctattgtggttttgtttcagacagtattcataagaaaattctcttattctttttactaaatgactcacatattttgtttcaaatttaagtttttaatcccactgggatgaatttagtgtaaggcgtaagtacggatccacaatgtttccatatggatatctgaatggtttaactgcttttattttattttatttatttatttatttatttattttgagatggagtctcgctctgtcacccaggctggagtgcaatggtgtgatcttggctcactgcaacctccgcctcccgggttcaagcgattctcctgcctctgcctcccaagtagctgggattacaggcgcccaccaccacgccaggctacttttttgtatttttagtagagagggggtttcaccatgttggtcaggctggtcttgaattcctgacctcaagtgatccgcccgagtgatctgcccgcctccgcctctcaaagtgctgggattacaggcgtgagccacagcgcccggccttgactgcttttaaaatagtcatctttctaaattgccctgctgtttccactttctcgtaggtatctgtttccattttgtttcttcagtttcattggcttgtctctattttttccaatacaaagctatcttaattaatttattttcatcataaattgtaaggtccagtagataatttctcttatgttattactgcatgagagtgtctttggttttctttggtgtgaggtttattttttcatattaattttgcgtcagcttatgaaggacattaggaaatctggttgaggttttggctggaattaacattgacaatttgggtggaattgatattttttatgattttgacttttcctattgatatttgcagtataaatctccatttatttgcttttattttttttctcttatgaataagttcacctttaaaatggtgaaaccatagtattcatctctcagggtaggttaaatttcttacaatagtgaggggactataaaatactttttatctttggtgaaatttacccctaagttcatagcatttgagtttgctattgaaaaatttgttatttatatttttaaattaacaattacacatttttttaaaaccagttaatcaccaagtatgctaatcctaaattacattttctctcctcactgatgtgtgtgtcccctctgtaagacaccatgtggatataaatgctaagtatgattctgggcctctggtcttttcctgtgagctactttgtctctcactgtgcctataccactgtcttgatgagtctggctttctaaaaccttgattggtagtaaggcacgtgctccaaatgtatttgtttcttttacagatatttttgagttttcttacctctctttttttcaaatatatatgaaaatctggttatcgatgtcctcactcaacctagtggatattttaagtggaaaaatattgtatatagatagcatattgaactgtgagatgcttcatgtatggaactatcttatgcatgaacatagacctgattaagttatgtgcattgacaggttggaaagatgcatttaagatttaagaacaatcaatgacttcctctgtttccactagagtccccacaaaattgaaacacattaggggaaaaacgtagatgaagtccaaaatatttttaaaaatagctcacagataatgactcataggacaaaacattcagggttggagctcagccagctttaagttctcagagcttaaagggtcagggtcactagctcaaacctgaggcccctaatcagcctggcacctgtcctaaggttggaatgggctgatactttgcactggacactcttgttccctgagagatgcccactttgctctacttgcctcatttgttctaataagatcctatactggtgatgtcagcaggtgtctgatacaaggaaatatgttgtatggagtgggagaggtgaagagtagtgaggtagtgatttcatggtgtgggatacattaggaccaacccacttagaaaaaaatgaccttagcaacaattttttaccactaatgcccttggcaaaaacatccttaagaacaattgcccttggcaccaacacttttaaaaatatgcctatcacaacaatgactcttattaataatggcccttagcaacaaatcccatagcaacaatacccttagcatagacaccatcaggaataatgctttaagacaacattgttaatattaacccttttagccaaaagactcttggcaacataatctaagcaacagtaacattagaaaaatgccctcagctataacactatttgccacagttgttcttagcaacacctttgactgacatcaacactcctagaagcaatatcttacattagcaatcatagaccttaacaaccaccccaaacaacaatgaccttagcaacaaatagcttgacatgaatacctttaccaaaatgtcgtttaaaaaaatggcctttagcatcaagacccttaacaaaaatggcccttaggaaaaatgaccctagagacaacactcataacataacaacaatggtccctaacaacaatgtccttagcagcaacatcattagcaatggtgcaccttactgacaaatctctaagcaacaacaaccttagcataattgcctgtagaaatagtgggaattatgccaattgcaacaatgccattggcaacaatgtctttaaaatcaatgtccatagcaacaatgcccttaggaacaatggtatgtccatttacctctataaattgccatggtactttggaaatggtcaaaccatggcctgttagtgtatcttagcaaaaacacccttagaaataataccttcaaaaaccatggcccttagcaataacaaaattagaaataaagcaattagcaacaatgcccttacaaaaatgtcctttatagtggcattaacaacagcactcttaccaatggcaccttagtaaaaatgcttttagtatcaactccttagcaataatgacatcagcaacagtgttgttggcaacagcacactttacagcaatgtcctagctacaaaatacataatatcaatgaacttagcaagaatggctcttggagacaatgctccgaatggtaatactcatagaatcaacactcttaacatcagtaccattagcaagaaaggggtaaacaaccgaccttagaaatgacattcttaataatgtccttagtaaaaaaatcatgagcatcacccctataaccagtgcccttagcaacagtgctcttatccaaacttgccttaccaagagtttaccattgtttaccttataaacaatggcccttagcaaccacactctttgcaacaatgtcctaacaatattactattagcaaaaatcccctaagaccagcattcttgacaacagccctcttggcccttagaagcaatgactttagcaaccaacgttgagccataaaaataaagccttggtaataatgctcttagcattgaccttagtaaaatggtcttagcaacagtctttagcaagagtgactctagaaatgtccccttcccaacaatgccctttgaagaaaatacctgtaacaacaatgcctttagtcacaatgccttcagcaaaaatgtcccttgccaacattaacaccctaggaacaatgatctgagaaacagtgtccttaacaataatatacaaaaacattctaagcaatagtaccctaagcaacaatatacttagcagtaataccctcagtaacaatactcttagcaacacgagatttaggatcagtgctggtagaaacagcatcatgagaaacactagcaatagtaataatgcctttagccacaatgaccttcaacagttctcttatgaacatcacccataactacaatggctccaggaacaatgcacttagaaataacttccttagcaacagtgaccttactatcgatgccaattgaaatatcatccttaggcacgtgttccatggaagcaacatcattagtaaccacagcttttgtaacaatgacttttagcaaaaacattagcatagtgccttaacaaaggcccttagaaacaatgcaactacaggccgggcaaggtggctcatgcctgtaatcccaagcacattgggaggctgaggtgggtggatcacttgaggtcaggagtttgagaccagcctggccaacatgatgaaaccccatctctaccaaaaatacaagaattagctgggcatggtagtgcacgcctgtaatcccagctactcgggaggctgaggcaggagaatcacttgaacccgggaggcggaggttgcagtgagctgagatcatgccaccacactccagcctgggcaacagagggagaatccatctaaaaaaaaaaaaataaaaaaaataagaaaagaaaagaaaaaagaaacaatgcaattatcatcaattcccttagcaacggatcctttagaatataatgctcttaacaacagcactcttagcaacaacatccttgacaacagtgtacttagcaacagtgcctttagctaaaatggcctttagtaaaatcaactttagcaacaatgcccttataaaagatgccccttgtaacagtgtccttagccagaatctctttaggaacaatgcctttaccaaaatgcatttaagttcaacggccttagcaacactgtccttggcaatattagatcttagtggcaatgctctcagcagcagtggtactcagcaatgatttctcttacaacacccttaacaacaatacccataacagcagcacactttaaaaaacaggcttagcaacaatgtccttaacatcaatgccttttggaacatcaaccttagcgacaactgcacttactaagagtgcctttagcatcagtccccttagcaataccaccattcaaaccaataccccttagccaaaatgattctaataacggcacactttattttctttttgacagagtttccttcttgttgcccaggctggagtgcaatggcatgatctcggctcactgtaacctccgcctcccaggtttaagccattctcctgcctcagcctcccaagaagctgggattacaggtgtgcaccactaagcccagctgattttgtaattttagtagagatggggtttcaccatgttggttggtcaggctggtctcaaactcctgacctcaagtgatccaccggcctcggccttccaaagtgctgggattacaggcgtgagccagcgtgcccggccaacagcacactttcaaacaacaccttaacatcaacatccttaactctctttgcaacaatacccttaggattaagtccctgagcaatagagtcattaacagcagtgtatttagtagcaatgcttctttactgtaatacacttaacaataatgaacatagtaacaatgcccttagccataaaggactttacaacaacaaccttagcaacgacactcacagtgacagtgtccttcaaatgagtttcttagaaacagtggtcttaggatcaacattttagcatgaatgctctttgcaacaattattctaggaaaagtgcttctagcaactagccctttagcaacaacacactgaacaagaatgctctagcaaaaatgtacttaataacaacatccttagcaaaaatacccttagcaaaaatgagtcttagtaacagagccttaatgtcaatgtccttagctacaatgcccctaatatcattgtcagagtgacaatatccttagcaacaataggccacatcaacaaaacacctagcagcaagttcctcagtgacaatgtgcttaatataaatatccttactcacaatgtcctttagcaactcttataggcaatggccttaacaataatattcataataatattttccttacaacagtacttaacaacctttgcacagcacccttggaaaaaagccaatttagcaaaacctttcttggctaccaaccatagcaacaatgccctaagcaataacacctttagtatcatttcccatagaaacagtggctataaaacaaggccatcagcaacagcatgcttagcaaaaatatctttagaaacaatactcttggcatcaacaccttaaaaacaacctcattattataactgcctttaataaaaatgccatgaacaaccaggcccttagcattggtgcagtatcaacagtgaccttagaaacagcaccattaacaacaactctgtgagcagcactatttgcaacaatgtccttattaacaatgcatttagctagagtacccttagcaattggctcttagcaacatcacatttggaaacagtactcatagcagcagctcccttatcaacatcactcatagcaaaatctgttttattttcaacactcttactatcaaggcctttaagaacaatgactctaagaaaatagcccataacaacaatttccttaaattcaacactctttccttaggaacagcacctttagcaccaatgatcttagcaacagtagcctctgcaatagtggccatggccacaatgttcttagtaacagcacctttagcaaaaacatccaacaacaacattaacatcaatgcctttggctgggcacagtggctcatgcctataattccagcactttgagaggtgggatcgggaggattgctttagaccaagggttcaagaccaggttgggcaatgtagtgagatctcatctctacaaaaagaaaaattaaaaaaattaaaaagctagctacatgatatggtttggctgtatccccatccaaatctcatcttgcattgtagctcccataattcccacgtgttatgggagggacccgatggaaggtaattgaatcatgggggtgggtctttcccatgctgttctcataatagtgaataagtctcatgaaatttgatggttttataaaagggagtttccctgcacaagctctcttgcctgctgccatgtaagatgtgactttgctcctcttttgccttctgccatgattgtgaggcctctccagccatgggaactgtgagtcaattaaatgtctttcctttaaaaattacccagtcttgggtatgtctgtattagcaacatgagaacagtctaatacactaggcatggtggtgtgtgcttgttgtcccagttgctttggagactgaggcaggaggatcactttgagcacaggagttcaagcctgcagtgagctgtgatcatgcaactgcactccagcttgggtgacagagtgagaccctgtctcaaaacaaaacaaaacaaaacaaaaatgcctttaagaacagcatgtttaacaaaagaacctcagcaatgacttccttagccacaacaaccttggcaaaaatattattactaccattctcttagcaattaagtccttaggaataatgctctgagaaaaaaagtgcttttagcaacagtttccttagaaacactagtcatagcaataacacccttagcaaaactttctttgcacaataacttcaaggccttaaagaacaatgcccttacaaaacttttttgacatcaacacctgccttataccattttgtgttgctcaaaataaatacctgaggatgggtaatttatacagaaaaaccatttagttggttctcaattctgatggctgggaagttcaagattggacatctgtgtcaggtgagggcctcaggctgcttccactcatggcagaagatgaaggggagctggtgtgtgcagagctcacatgatgagagagagaaagagagcagaaaggtctcaggctctttttaacgaccagctctggcaggagctgatagacgacacactcagcctcaaggaaggagattaatctgttaatacgggatttggtcatatgacccaaacacttcccattaggccccatctccaacattggggatcaaatttcaacatgaggtttagaggggacaaacatccaaaccatagcaatacccttaagaacaataaccttaccaatagtacccttatcaaaaatgcccttaacaacagctttcttagcaacagtacagttactaacagcactcatagcaaaaccttaatcttcaataacacttttaatatcaatgcctttaagaatgacaatcttgaccagatatggtgactaatgtctgtaatcccagcactttgaaaggttgaggcaggaagtttgcttgaggccggcagtttgaggtcagtctgggcaatatagtgagatgctgtctctacaaaaaatttttttaaaaagtccggtatggtgacctgtgctcgtagtcctagctacttgggaggctgaggtgagaaaattgctggagcacaagagtttgaggttagtgaaccatgatcataccactgcactccagcttgggcgacagagctagactctgcctgttttttttttaaaaaaaaaaaaaaaaaaaaaaaagaggaccttcaaaattgcttccatcaacaattacctttgcaaactttccatcaacagcaatgctcctagcaagaacatcttttgcaacaatgcttttaacatatctcattttgcaacatagaaacaaatgcagttaggaacagcatccttaacaacaactttctttacaacgatattaacacaagagtcttgcaacacccttaacaacaagtttcctttgcaacagggccataacatcaacactcttggtaattgcattggtaccaaaacttatctgtgacaatatcttgaacattaatgcctttaagagaaatgctcttaaaaatatctttagcaagcatttccttagcaaacacgctcctagcaacagagagtaagttttgtaagggcatgtgaatatgaaggcagagactggagtgatgccaagaaatgtgaaagatttccaggaaccatcagaagcaaggaaaaacgcacggaaaagattcagagtgctcagaaggaagcaaccctaccaccacctgatttggacttctaagctccagaactgtaagataaatttcttttgttttaagccacctcgtttttggtactttgatgtgacagccctaggaaactaatacaattctcttaacaaaaaggcaacaatttccttagcaataataaacttagaaataatgccttctcaataatgactttgccaacaatggccatagcagccacaccctcagcaaaagcaacttagtgcagatttcttagcaaagcacgccaaaacacactaacaaacatactaagaaaacacaaaacacactaatactaacaaagaaagtgcctttctaaaaactgcctaacatcaacaatcttatcaacacatttcatagcaaaaatttccttagcacctttgcccctagcaatgttgtctttagcaacagttttcgtggcagtagtgaccatccaaccttgatttagcaaatgcatccttagcaaaaactttcttgcaacaccacccttaatactaacacctttaagaacgatgtctttagcataagggccctctcaacaatatcattagcaaaagcttggcaaaatgtgcttagcaaccgcactctttgaaaaagttccattaatagcaacatacttaataacaatgtctttagcaacggtggccataggaattgctccttctgcaagagtggctactgtaattgtgaccagagcaataatggccatatcagccatgcatttagttacagtggcagtaacaactatgtccttggtggcagtatgtgtggggaacatttcttagcaacaacacccttatctaagaggccctaggagcaaaatccattgcaacactatatgcagcaacaatgtccttaattattaggttgatgcaaaggtaattgcgatttttgccatttcagtggcaaaaaccgcaatcacctttgtaccaacctaatacaattcccttggcgacaatcttcttagcaacaacacccttggcaacaaagctcttagcaatatccttagaaacattgtctttagcaacatttcttagcaatggtgcccatagcaacagttccctagtaacagcaaccttaggagaaactccctttgcaagagcacatttaacatcactgcctttaatgaaaaaccacttaataaagaagtcctggctgggcgcgctggctcacgcctgtaatcccagcactttgggaggccgaggtgggcagatcacgaggtcaggagatcaagaccatcctggctaacatggtgaaaccccgtctccactaaaaatacaaaaaattacctgggcgtggtggcaggtgcctgtagtcccagtactcgggaagctgaggcaggagaatggcgtaaacccgggaggcggagcttgcagtgagcggagattgcgccactgcactccagcctgggcgacagagcgagactccatcgatggcctgatggcctgcaggtgtctgttggcctgctcttccgccagtgtgctttcgatgaccagctgcttgtgtcttcttctgctgatgtgttccttatgatgtccagctgcttgtgtccatgccttgctaaggtctctggtttttataggcccatgatgggggcacagcaggccagggtggtcttggaaaatgctacatttcggcatgaaagcagaagtgcctgtccttacctaggtctgtgggggtggagccctagccagggaccacgccctcctctacccagcacttcccttctccccttccctatcatttaaagggaccacgctcttcccttcccagcacttccatatcagtttggtacacaggtaaactcgtgtcatcgaggtttgttgtacagattgtttcatcacccaggtattaagcctaatgcccatttgttattttccccgttcttctctctcctcctatcctccaccctcatgtttccctctgtgtgtccatatgctctcatcgtttagctcccactataagtgagaacatgctgtatttggttttctgttcctgtattagtttgctaaggataatggcctccagctccattaatgtttgcgcaaaggacatgatcttattcttttttatagctgcatagttttccatggtgtatatgtactacattttctttatccagtctatcattgttgggcatttagggtgattccatgtccttgctgttatgaatagtgctgcagtgaacatacgtgtgtatgtggctttataatagaatgatttatgttcttttgggtatatgcccagtaatgggattgctgggctgaatgacatttctgtcttcaggtctttgaggaatcatcacactgtcttccaaaatagtagaactaatttacactcccaccaacattgtataattgttcctttttctccacaacttcaccagcatctgtttttttttttttttttttttttgctttttgctttttaataatagccattctgatgagaacacatggacacatagagggtagcaacacacactgtggtatctcaaagggtggagggtgggaggagggagaaggtcaggaaagataactaatgagtactaggcttaatacctgggagatgaaataatctgtacaataactccccatgtcacaggtttacctgtgtaacaaaccttcacatgtaaccctgaacttaaaataaaagttaaaaaaataattaccaattaaaagaagaaatttcaggtttttaaaaagaaattgtaacagttctgctgaacaatgtttcaggatatcattttcttttagaaaaacatgtattgtgctgctgtagggtggagtgttctataaatgttaggtatagtttataatgttttattattttaaaaaatcaccattctgactggtgtgagatggtatctcactgtggttttgatttgcatttctctaatgatcactgatattgagctttttttcatatgattgttggccgcatgtatgtcttcctttaaaaagtatctgttcatgtccttttcccactttaatggggttggttttttcttgtaaattagtttaagttccttatagatgctgggtattggacctttgtcagatgcatagtttgcaaatattttcttgcattctgtaggttgtctgttgactctgttgatagtttcttttgctgtgcagaaggtctttagtttaattagatcccatttgtcaatgtttgtttctgttacaattgctttttgtgtctttatcatgaaatctttgcctgtgactgttctgaatggtattgcctaggttgtcttccaggatttctatagttttgggttttacatttaagtctttaatccatcttgagctaattttttaatatggtgtaaggaagaagttcaatttcaatcttctgtatatggctagccagttatcctagcaccatttattgaatagggaatattttccccattgcttgcttttgtcaggtttgttgaagatcagatagttgtaggtgtgtggtcttacttgtgggttctctattctgttccattggtttatgtgtctgtaccaataataaatttgtacaaataaatttgtaccagtactatgttttttggttactgtagccctgtagtatagctcaaagtcgggtagcgtgatgcctccagctttgttgtttttgcttaagattgccttggctatttgtgctcttatttggttccatatgaatattaaaagagttttttttatagttctgtgaagaatgtcagtgatagtttaacaggcatagcattgaatctgtaaattgcattgggcagtatggccattttaacaatattgactctttttttctctctctctcttttgagatggagtctggctctgtcgccaggttggagtgcagtggcacaatcttgactcactgcaacctccgcctcccagattcaagcgattctcctgcttcagcctcccgagtagctgggactacaggcgcacaacaccatgcccagctagtttttgtatttttagtagagacggggtttcaccatgttggccaggatggtctcaatctcttgacctcatgatctgcccatctcagcctcccaaagtgctaggattacaggtgtgagccactgtgcctggccaacaatattgattcttcttatccatgggcatagaatgtttttccatttgtttgtgccttctctgatttatttgagcagtggtttgtagttctccttgtagagacctttcacctcccttgttagctgtattcttaggtattttattctttttgttgcagttgtgaatgggagtttgttcctgatttggctcttggcttgacttttgttggtgtataggaatgctagtaatttttgcaccttgattttgtatcccgagattttcctgaagttgcttatcagcttaataagcttttgggttgagactatggggttttctagaaatatgatcatgtcatctgcaaacagggatagttgacttcttctcttactatttgaaagttctttatttctttatcttgcctgattgccctggccagaacttccaatactatatttaataggagtagtgagagagggcaaccttgtcttgtgccagtttccaaggggaatgcttccagcttttgcccattaagtatgatattagctgtgggtttatcatatatggtgcttattcttttgaggtatgtttcttcaatacctagtttattgagagtttttaacatgaatgaatgttgaattttattgaaagccttttctgtatcttttgagataatcatatggttttggcctttagttctgtttatgtgatgaataacatttattggtttgtgtaggttgaaccaaccttgtatcccggggatgaagtctaattgaccgtggtggatacgccttttgatctgctgctcaattcggtttgccagtattttgttgaggatttttacatcaacattcatcaagaatattggcctgaagttttttgttgttgttgttgttgtatatctgccaggttttggtatctggatgatgctggcctcatagaaggagtttgggaggaatccctcctcctcaatttttttgaatagttttggtatgagtaataccagctcttctttgtacatctggtaggattcagctgtgcatctgtctagtcctgggccttttttggttgacaggctacttattactgattcaagtttggagcttatttttggtctgttcggggactcaatttcttcctggttcagtcttgggagggtgtatgtgtccaggcatttatccatttctactagattttctagtttatatgcatagaggtgttcataatattctctgatagttatttgtatttctgtggggtcagtggtaatattgcccttgttgtttctgattgtttatttgaatcttctttcttttcttttttgttagtctagctagtggtctattttaattttttcagaaaatcatctcctggatgtctctatctccttcagtctgcctgtgtgcagttctagtttcagtctgtttcagagctcaagcttgaatacataagaagaaagaagaagactgagaagaaggagaaggaggggtggaagaggaggaataagagaggagaaataagaaggagagagggagggaggaagaagggaaagaggaaggatgatgagagggagggaaggaaagaggaagggaaggaaggaggaaatcaagttaggcaaatcaccgctaggtcatccttcaggtcctgagctccataccaagttcaggggtacatgtgtagctattaaaatgggaaaggttcccttgtcccttttgcagggcatgtgatggaggtgtggcttgcttcttcagtgcttcagtgccccgctggtcaaacctctaggggagcatacagacaggctgtggggcttcaaccccatggcaatgtctaggggtgaatgtttactactcttatccaacgttcagagtcttctgttagtaacattatgcattttgaccatgattatcagtgtaatcagtagataaggcagaatgtgtctactcaatctgaaccaaactggaactctgcaattgggatgtgtgcaactgtgcaccttcaaaatgtccatgttgaaattttagagcaactgattaatatgaccaaaagtacttaagagaaaagtttcaaaacactaattctaattataccagctcttgttcttttttatgttcatgcttaatattttctttctttatttattttattttttatttttttgagacagagtcttgctccacccaggctggagtgtagtggtgcaatctcagctcactgcaatctctgcctcctgggttcacacaattctctgcctcagcctccagagtagctgggattacaggtgcctgccaccagtcatagctagtttttgtatttttagtaaagatggggtttcgccatcttggccaagctggtcttgaactcttgacctcataatacacctgccttggcctctcaaagtgctgggattacaggtgtgagccaccatgcccagccatacttaatattttaatttcaaattttatatatgaatgtatgtatgtgtcagtatatatattctatgtacatattgtgtgtgtgtatatatacacacacacacacacagagagagagggaggaaggatataaaaattatatcaaagaagaatgtagtgctatttaaaccaaagaacacacgcacagctcttactattataatcatagaaaaaaatgaactgacattaaagggcattttaaatgttcatatattttgtctcttttactcagctactaaaatactcaaaatgtggtaagattctctaatgtttatatagtagaggttttttgtctttgtttaactagttgagttggattgcttatcatacaattgagagcttcgaatatcagaacagttacttacatgccaaaattgcttatgaatgttctgtcatgtcaaagttgttccattaccatatagaagtaaactctgatctgtatagatactaccagatgggtgtggtggcacatgcctgtagtctcagttacatgggaggctgaggtggaagggtcacctgagcctgggaggttgaggctgcagtgagctgcgatcacaccactgtactccagactgaatgacagagtgagaccctgtctcaaatgaaaaataaaatgatattactagaatatacttgtctaaacttttactttgagaaaacagaaaatcaaacacattgttctcacggtgttaactttcaaagaaatgatctgtaatttatctggtggaattcaatgcagttattttgtttataacatttttcaaaagctgcggttttccctgggtgtgtgtgggcacaattccattgtgataacactcatcttttgcagagtgctgaaagagtgagccaggacagccttttgacattgaacaaggcaattcccaatctcttggtgggtgaatggaggaagagtgatatcctgattgatgcctctacaattacttaaaaatatttggacactctagaaaattactctttttggaccatcccctcaggtcccttaaatatctgtgtccctttactgagcagcaatttgggtcagaaaaaatgggctctgaggatgctcagaaacaaaagtgttttggggagaaagatatggttctgaaggcctggagaggcaaaccatgtccagaaaaggtcccagatgatagaactccctgagtattcttgcagaaatgaatatccaccaggcttcttcttttttttttttttttttttgagatggagtctgtctctgtcgcccaggctggcgtgcaatggcgcgatcttggctcaatgcaagctccgcctcccaggttcacgctattctcctgcctcagcctcccaagtagctgggactacaggtgcctgccaccatgcccggctaattttttttgtatttttcgtagagacggggtttcaccgtgttagccaggttggtctcgatctcctgacctcgtgatccacccgcctcggcctcccaaagtgctgggattacaggcgtgagccaccgtgcccggccccttgtttttcaatcacaagatatgagtcattgcaggaaacaaataaaatggaaccaacacagagaaaggtagagatggaagaggtaagactaaattctagagatgctgcttattccctaaggtctgtcctttagcattttgtaacatgagttaaagtacatttgagttgtgtctttgtaatttgcatccaacagagccctggctgtgttcactgaatggatctagtctctgaaaattcaccgacatttttggcttggcgctgtggctcatgcctgtaatcccagcactttgggaggttgagacgggaagattacgaggtcaagagatcaagactatcctgggcaacatgatgaaacgctgtctctactaaaaacacaaaaaattagctgggtgtggtggtgcgagcctgtagtcccagctactcaggaggcttaagcaggagaattgcttgaacccaggaggcggcggttgcagtgagccaaggtggcgccaccgctctccagcctggcaacagaacgtgactccgtctcaaaaaaagaaaaaaaaaaaatttcaggggtatttatgtagtgacctgttatttgatttttcaataacataaatctgtttcaagaaaaagaaattttaaacaaactcttatgattttctttctcctgaaaattattccagaacttaaaaaaaagaagaaacaaaacagagtaagtacattagctttattcaacataccatcttgtctagtagtaaactactaaaaacagtctcctgagtggaaaaaatataaatttttgtctatttaacaagtaatagcatcagtgttgtcctgcgtgttctcattattttctccaaataaattggctcaatatgctgctaagtattaccatttatgtttattttgaagttctatatcttgtctttgctgtttcatctgtaaacaggcaattattgcctcaatgtgtattctgatacattttctctctaaatctattgtccaacatcttgcatataaaatctggcttttctctcatatatcaaaatcacaggtcacatagtctcagtgccaagagttacaagaacaactgctttatttcactcccatctctgtgaatacaaaacttcaatctctaaagtattttgtatctatttataacactatgttcctggcttattattatattatttcattattagttcttaaaaacttaaggtgctgaataattttgtgaaatattccatggagaactaccattaaaatagtgattattttaattatatttcatcacctcatttcacaagtcattacaaaacttcttaattgtttaaaaatgaatgtacttgggtggggcacagtggctcacacctgtagtcccagcactttgggaggccgaggaggccagatcacctgaggtcaggagtttgagaccagcctggtcaacatggtgaaaccctgcctctactcaaattacaaaaattagccgggcatggtggcacatgcctgtaatcccagctactcaggaggctgaggtaggagaattgcttgaacccaggagatggaggttgcagttagccgagatcatgccactccagcctggccgacagagcaagactctgtctaacaaaaaaaaaaaaaaaaaggaatgtacttatcagtccaagggaaatagctatcaaattagtcactgcccaagtatacgtcttttagtgaacacaaattgagaatttagcactgaatctccaaagatttagtttttatctaggttttgaaattgaattttgttttgttttgttttttgttttgagacagtgtcgctctgtcgccgaggctggagtgcagcggcgcaatctcggctcactgcaggctccgccccccgggttcacgccattctctcgcctcagcctcccgagtagctgggactacaggcacccggctaattttttgtattttttatagagacggggttctcaccgtgttagccaggatggtcttgatctcctgacctcgtgatccgcctgcctgggcctcccaaagtgctgggattacaggcgtgagccaccgcgcccagcttgaaattgtattcttaaatctcagaaggctgaagctttcaagacaggaagaagacagggattcccgagttgaacagagagtgggccgggcgcagtggctaacgcctgtaatcccagcattttgggaggccgaggcaggtggattccgaggtcaggagatcaagaccatcctggctaacacagtgaaaccccatctctactaaaaatacaaaaaattcaccgggcgtgggggctcacgtctgtaatcccagctacttgggaggctgaggcaggagaatggcatgaacccgggaggtggaggttgcagtgagccgagatcaggccactgccctctagactgggcgacagagcgagactgtgtctcaaaaaaaaaaaaaaaaaaaaaaaaaagaccggacgcagtggctcaggcctgtaatcccagcactttgggaggctgaggcgggtggatcacgaggtcaagagatcgagaccatcctggccaacatggtaaaatcccgtctctattaaaaatataaaaattagctgggcgtggtggcaggcacctgtagtcccagctactccggaggctgaggcaggagaatcgcttgaacccgggaagtggaggttgcagtgagccgagatcatgccattgcactccagcctgggcaacagagtgagaaaccctctcgaaaaagaaaaaacaaaaacaaaacaaaacaaaaagataataaacaagaaaatactaatgtagttgttaactttcagaaggcagtaatttaagacatggatgtgaatgcagataatggaagtaaggagagatcagtgtaggccacagtcctgtgctgagtgctgtctttacctgtcttgtagggatggctcagacaaagtcttaacaaacaggcaaatgactgatttatctttttagattctaaagttcataagaataataatgagctttatagttgacaatagctaactaaaatttggtctaaggggaaaagagcgcttaatgttaatcagtcagtttaatctttctgtaaaccctctcaaaaagcaaaattgaattagatcattgtggtgcactgattcttttggtatgtgtgtcccacctataataaagttctgggccaggtgcggtggctgacgcctgtaaccccagcactttgggaggccgaggcgggcggatcacaaggtcagaagatcgagaccatcctggctaatgcggtgaaaccccgtctctacttaagaaatacaaaaattggccggacgtggtggcgggcgtctgtagtcccagctactcaggaggctgaggcaggagaatggctgagctttcagtgagccgagatcacaccactgcactccagcctgggcgacagagccagactctgtctcaaaaacataaataaataaaataataaataaataaagttattggccaggagcggtggcttacacctgtaatcccagcactttgggtggccaaggtgggtggatcacctgaggtcaggagttcaagaccagcctggccaacatggtagaacttccctctctactaaaaatacaaaaattagccaggcatggtggcgcaaatctgtaatctcagctactcaggaggctgagacaggagactcgcttgaatccaggaggcagaggttgcagtgggccgagactgcaccactgcactccagcctgggtgacagagtgagatgctgtctcaaaaaaaaaaaaaaaaatttatctgaagactgaccccacaatggtgagccctgcctgccatgtttgtgttatggaatcatgtcccatacctgaccctatttatttaaaggtagaacaactgacccaaccacattttctctttaaaatgtgggaattgggattgagagatactggtctttccctatgggtcatttcaacttagaatatttaagtttgggatcgttggtgcttccatatttaaccagcagcttagaaaagcagacatagtcgatctgtggaaagaaaagctgaagtgatgtggagagagaagttgtgaaaagcgatcagagcgcctgggagagatttacttagggtagctggagctgttcctggagctctttccagactttggttctagctcttgaagctaccaggcttccagcctttagaataattccattttaacctcagagattttgcgctggttcaacaccaaacaaaagaacactgaataagacagtaatgtgagtagaaaattctatgaaatagaaaagaaacttaatgatgcgtcataggccattgatattcactttcctccgtcccatgtatatagatcacttcgcctcttccaaaattcttatttcataataaagattaactagttatttaaaagttaaccatagcctatttattgtttattaacgaacgtgtttaaaaggatcaggtgctaaaccttggaagaatattaaggcaagatgttatgagatcacagaagcttagtgctgaagggtccatgccttcacgtgggtacagattcctctctgagtgctcattcacccattgtggtgtgagccctgtgtgaaaactcttcagatgcagacatgaataagacaaggtgtctgctcaaagtcaactagaggagacagtaagcaaataattagaatgtggaacatgccataatcgaagtggatgggtgtcatgggagcacagatcatggggtatctaactttgctttggaggttaaagtatagcagtcatgaagacttcaaaggggaggtggatttttattggaactgttgagaataaacaaggatatacatattttcaactatggcctgagcgtatatgagctttaagagctgaactgttgggggcattccagaccaagaggaagtcgtgggcagaggcaggaaggtgaaaggagtatgctgtttttgggagaagcatagttagtgcagaggggctatgactcagggcacacaggatggcagagtgtgtctgggagatgaaactggcttacaggcaggaagtgaggaagaaaggactttctgaacttcttatggaatttagacttctatagataacagagaatcactgtatgaatacactgtcatacattctttgagagaaaacacattcatttttgagaatcctcattcctgaattctttttgtctgtggtacagcttcctgcagccccatccaccaattacagacctatcttcttagtgtgagtctaatgtctcctccatgggagggagctgtagaatttaaagttgaccatcctgctcatgcctgagttttctctctcctgcaactaacgccttcctctctgtctgagacctggcatgtcagggtagaaggcccttcaccctccttctcttgacaaactctgatttattgacatcttactgaatatccaatggctggaactgggatcaagctcttcagtgtggtctgaagctgggggcaggagagacctcactcccttcaaattcactaagatatgaggtgacctcatcataccacaggcttttgtcaaggccacagggacataaactcaggtcacttttgtttcacaggcattattctaatatttgtggggttttttttgtttgtttgttttttgagatggagtctcactctgtcacccaggctggagtgcagtggcacaatctcggctcactgcagccccgcctcctgggttcaagcgaatcttctccctcagcctcccgagtagctgggagcacaggtgcacaccaccacgcccagctaatttttgtatttttagtagagacagagtttcaccatattggccaggcaggctggtctcgaactgctgacctcgtgatcttcctacctcggcctcccaaagtgctgagattacaggtgtgagccaccacgcccggcctaaatttgtgtatttttaaactaaagtgtcaaactacatttatcgccctcttcttagtttggaaaagtgctttgtttctgttaagactgttttaggttttatctcttcaccacacacaggctgctccttccagttcagtattagctgaggatttcatttcagtcctcatacagagcagtgataacagctgaataaaccagagctgaaagtgggcccatgtccctctttcctacctctctttcacacctgagtctgattgagtgcagtatgcaacttggatgagcgtgtgtatgcaaagtgcacgtcagcaatgaccatagctggaacaggatggagctagccacctctttatcatctccctgctcattctttgatgcagaaaactaaccttgtctcaagcatgtgtaaataattcatgcaaagttacaagacatggttcaagtcatgccccctccaaccacatcagcaccatgagcagtccttgagggtcttcagataataacaacactaagagttagcatatgttgaatgctgtactatgtatgtcattctaaggggagaagctatgtagaaccaaaagtaagcacaggcagcttcaagcagcacacagaaacgcaacacaggaggtggcttatttgattgtcattgaagttgtgaaaaagtgttaaaaataataaatacaatagtttaaaaaagaaacaaggaaagtattatataccataacaaagtgggatgcactccagaatgcaagcctagttcaacagtcaaagatcggtccattataccaatgggttaaagaagaaaaatcatgtaatcttatcaatagatgcataaaaagaatttgacaatatctaacaatcattcatgataaaaactttcagcaggctgggtgtggtggctcatgcctgtaatcccagcactttgggaggccaaggcaggcagatcacgaggctaggaaatcgagaccatcctggctaacacagtgaaacctcaactctactaaaaatacaaaaaaaaaaaaaaaaattagccgggcatgatagcgcgcacctatatcccagctactcaagaagctgagacaggagaatcgcttgaacccaggaagcggaggttgcagtgagccgagatcacaccactgccctccagcctgggggacagagtgagactctgcctcaaaaaacaaaacaaacaaacagacaaaacaaaaactttcagcaaactagcaatagagagaaacttcttcaaattgattttttaaatctaaaaaacccctccacttaacatgatactcaagcctgaaaagtgagatactttcccactaagaacaggaacaaaacaaggatgtctcctcttatcactcttatttaactttgtgtggaaagtcctaactaatgcaataagacagaaaaaagaaataaaaggtatacagataagaaaggaagtgatagcggagcgcagtggctaacgcctgtaatcccagcactttgggatatcgagggaggcggatcacgagaccaggagatcgagaccatcctggctaacatggcgaaaccccgtctctactaaaaatacaaaaaattagccaggcgtggtggcaggcgcctgtagtcccagctactcgggagactgaggcaggagagtggcatgaatctgggaggcagagcttgcagtgagccgagatcgagccactgcactccagcctgggtgacagagcgagactctgtctcaaaaaaaaaaaaaaaaaaaaaagaagaaaggaagtgataaaactgtctttgttcatatatgccatgagtgcctatgtagaaaatcacaaagaataaacaactcctagaatgaatgctatgtatataatcttttataagtgattacagcaaggatgaaggatacaaagttaatttacaaaagtcatttctttttctatatgccatcaatgaacagttgaaatttaaaattaaaaacacagtgccatttacattagcaccaaaaatgaaatacttaggtataagtctaacaaaatatgtgtagtatctatctgaggaaaactatgaaaatctgatgaacgaaaccacagaagatctaaaaaatcgacttactgcatgttaatgaataagaaaattcaatattgttaagatatcagttctttcaacttgatctacagatcagtattgggatcaatgcagtacttatcaaaatccaagcaagctactttgtagatattgactagctgactccaaatctatagaaagtcacgagatgcagaaaagccaacataatattaaagaagaacaaaattagagaactaatgcttaatgacttcaaagggcttactgtaaacttacagtaatcaagagagtgttgtattggtaaagaatagacaaatagatcaatggaatagaacacagagtacagatagagaccctcacaaatatagtcaatagatctttgacaaataagcaaaggtaattcaatgggaaaaagatatggttcttaacaaatggtgttaaaactactggacaaccacatgtaaaaaatgaatctagatactgaccttatacttctcacaaaaattaactcaaaatggatcatagacttaaatttaaaggcaaaactataaaacttctaaaagatagcaggagaaaatacaggtgaccttgggtttgactatgagtttttaattacaaccctatagtgtgacctatagaagaaaaacttgctaagtgggactttattataattaaaaaaataaaaaaaaacttctactgcatgggtgacactgttaaaagaattagaaaacaagtcacagggagggagaacatatctgataaagggctagtattcaaaatatacagagaatacttgaaactctacaataagaaaacaaataatccaacttaaaagtgggcaaaaggccgggcgtggtggctcacacctgtaatcccagcactttgggaggcaaaggtgagaggatcacgaggtcaggagttcaagaccagcctgaacaacacagtgaaacctcatctctactgaaaatacaaaaattagctgggcctggtggcacgtgcctgtaatcccagctactgaggaggctgaggcaggagaactgcttgaacctgggaggcggaggttgcagtgagccaagatcgcaccactgcactccagcctgtgtgacagagcaagactgcatctcaaaaagaaacaaaaaaagtagctggaatcatacagtatgtatgttgatattatttttccagctatattataaactccacatgggcaacgtatattccctaccttatataatgtataatatatacaatatgtacctggtataatgtataatatgtacatatttaataaacactcattattataaatattcacaaatatacataataaatgttctctaatcaaccacatagagtttttttaacacctttgaataatgcaataggaacaatctattaaaataaaacagaaaaatattcaaatttaaatgaaacaaagcaactgccaaattattaaatccaagttccttattttaggcgtcaaatgcaaatattcttatagcttttattgcacatacatgttggcggtcatggtaaaagaagatacaactctcaacttcaataaaatgtatttcaatattcaataaaatttcaatattataagaaaaccaaaatgttgtgttagtaccaggacagttgcatttgtaagtacttgtgatttctttttctttctttcttttttttttttctgagatggagtcttgccttgttgcccaggctggagtgcagtggcgccatctcagctcactgcaagctccgcctcccaggttcacgccattctcctgccacagtctcccgagtagctgggactacaggcgcccgccaccatgcccggctaattttttgtatttttttttttagtagagacggggtttcaccgtgttagccaagatggtctcgatctcttgaccccacgatccacccgcctcccaaagtgctgggattacaggcgtgagccactgcgcccggcccatacttgtgatttcacgtgcacagtgagagtttgactctttcatcctcgcccaaatactttttcatcccatgactgttgggcttttgtttccctttctttctttctttttttaagattgcaactccatcaatactgggatgtctattcaagctagctaaatatgttgattaacttctccactcccagcacctcctagaatcccactgcaataacaacaaataagaacaaaggggccgggcgcagtggctcaagcctgtaatcccagcagtttgggaggccgaggcgagtggatcgcttgaggccaggagctcaagaccagcctggccaacacggcaaaaccccgtctctactgaaaatataaaaactagccaggcgtgttggtgcgcgcctgtaatcccagctactcaggaagctgaggcagaagagcttgaacctgggaggcggaggttgcagtgagcccagatagcgccaatgcacaccagcctgggccacagagtgagactctgtctcaaaaaaattaaaaggaacaaaatgaacccatttatacaaagactacaagggtggagagacttggatagcatgcaggatattcacaagcaattctggaagaaaaatgacagatgagtgcattctgttattaaaatcacagctcagagtcctcccaggaaatggctgcggtgtgtagggagctgtctttcacagtgatgaaaagaactctaggttcagagtgggcaggtatctggaagaacattttttcgccagcatccctttatttattgatacgtcgatgagaatagtaccacagcccaatgacatttatcatttcagttggcagtgtctctgagagcaagctgcaagatttccaagccttcactgagtcttctactgacatttagcttaatcttgacaagtatatctgactactgcaatgtgttaatgatcaaggagtatgtcaaattataacatgtctgctgcaggaaattatggggtaatacagacagtgtgcactggatcaaccattatctatgcctggtgttatgacaaaaagtgattgattttggcatcaaaattaaagtgttcgtctggttcaacttgttctttgtacaccgtccttcattatgacaagcacatatagcaaaaatactgtcttcaatatgaactgttgattattgattaaacagatcacatttggatgggctgcagtttctgcatgtctaacgggtgggatccttctgagaatgctagaatagggaatcatgacaccgagccacttcagtcatagaccttattcttgcacttttttttcttgctggcaattttacatagcaggttgagaaagctactctatgctagtatagactatacaccaataattttgataatgagttccaggatgtatttttcttcttatatattttccttcctaccatgatactagtaatttataaggggtctgtgtagtttgaatgtatttgaataactttagctctactgtttgatttgaaccaaagaagcgaagaggacgtaaatattcccatttagaagcccaaagtcagtgagatgaaacccaacatcaagaaattgaagcaaagttacttgtggataaagaaagcattaggtaagttgtctagagcataataattagattttctggctttcaaaaatttggattgcaataagaggaaacttcatgctatttttacaattttcagtacaaaggggtgtatatctagaaacaataaagttgacatatttgagtaccttttcaaaaaaaggtaaccataacctattttttttttttttattaaaaggaccaggtgctaaaccttggaagaatattgaggcaagagtattaaggcattttaattcagcttaagtatcatgttaagtcgtggaattcagatgtaatagaatgcataaaagtgttaatcaccagtgcttaagatggcccacagaggttgttctaccaggcatatagaaatctttctcactatgcctgtttgtgagcaggatcagtggttttgcactgcaggcacacatttcattttgtcaaatatttttgcaacctcccctctacttaatagtttaatcactacatctatacaaactacttggtcaatgagggcccattttacttgtgtcttccagaaatattttgcattaccccaaatgacatcttccagcagatcttcctcagatataaagtttccaaaaaactggcaaataaaattactatcttcagaacttttctgtatttaaaaataacaataaaaagctatgaatttacataaaattcaaaccattgtgtttatagccacagtcctccacacaattttcatgacaccattggtaaaatcatgtataagcaacattcctttattcctagaaagtgtttatatttcaaaagcactttatttttcttcagatattcccctgaagaaatttggaaagaaattgaaattgcctgtggttgtagccaattcacctgtaaagaatataaaattctccccatgaactggtcatcccagtgtcacacttacaagtctgagaaaagtgcaagaggttattgggaagtattccttcctttttcaattttctctttaattggaataattggtaagaactagcagaattggtatcatatttttcttaaatgtttggtagaattcttcactgaagccatttagacctagcattggagtctttgtggaaaggttttaaattacagcttcaatttctttaatagataccgggctattctgtctatttgtttttgagtaagactagataattgtgtctttggagaaatttgtccacttcatctaagttgtcaaatctgttggcacaatgttgttcataattaccatttattatctctttagcatctgttgaatctgttgttatgttacttctcttattcctgataggttgtttttgtattctctctttttttcctgataagcctgaatagaagtttatcaatactatggaccttctcaaagagacagagtttggtttcatttatttcctgtaaatgatttttcctgttttctattgcattgatttctacactgatgctttttacttcctttcttctgcttactgttggttttattttcttttctagtttctttttttttttttttttttttttttgagatggagttttgctcttgtaacccaggctggagtgcaatggcaggatctcggctcaccgcaacctccccctcctgggttcaagcgattttcctgcctcagcctcccgagtagctgggattacaggcatgcatcaccacacccggctaattttgtatttttagtagagactgggtttctccatgttggtcaggctggttgaacttctgacctgaggtgatctgcccgcctcagcctcccaaagtgttgggattacaggcatgagccaccatgcccagcctcatacctgattttattgtcctttgctttactgcacttctcagatactgcattttttataaattgaaggcatgtggcaaccctgcattgagcaagtctatcagcaccattttctccaatagcatgtgctcactttgtgtcactgtatcacatctggtaactcttgcaatattttaaatttgtattattatgtgttatgtgatctgtgatcagtaatctttgatgttactattgtaattgttttggggtgccacgactgtgccaatataagatgacaaacttgccagtaaatatgtgtattctgactgctccaccaaccatcccccatctcttttttcctctcttcaggcctctgtattccctgaaacagaacagtattgaaattaggccaattaacaatcctacaattgcctctaagtgttcaaatgaaaggacgaatcacgtatttctcactttaagtcaaaagctagaaatgattgagctgagtgaggaaggcatcctggaaaccaagatagacgcgaagctaggcctctttcaccaaacagttggccaagctgtgcatgcaaagagaatgttcctggaggaaattaaaagtgctactccagtaaacacacaagtgatgagaaagtgaaacagacttattgctgatatggagaaagtttgagtgctctggacagaaaatcaaaccagccacaacattcccttaaaccaaagcctaatccagaggaaggccctaactctcttcagttctatgaaggctgagagaggtgaggaagctgaagaagaaaagttggaaggtagtagaggttggttcgtgaggtttaaggaaagaagccatctccgtaaattagcttttaaaacttttttaagcaggcaatctctgactttgcttcagtaacatttccttctcctgctctttctcattttcccattgctcatgcttatacctgcccatctttctctagtattaaagtttggataaatgtttgatctttgaataatattttatattgttatatgcctctgattttatcctctggacaaacttgagagacagtgcaaaaatttctttatatctttataatataaagaattatggcaaattttaaaagaagtaccagccttattgaggtataatttacgtataataaactgcaccctctccaccccctcccctcactgtctaccaaaaaatgtctgatgatatcctggcaatctgaccctgcctggaaaacaccatagagaaagacagcaatgtgcttcctcactctggagttctattggattttaatggccatagatgtattatgagccacacaaaccagcactaaagtagagaattttttccagaaaaggtgtgctaaaaaagcatgtaaacgaaagcttttatttgttttattttcagcaaccaagacataaaattattaggtaggccatgatacacaaacactaaccactgtaccatcctttgatgttcattgcaatggattcaatgtttgtgccccccacaaaaattcatatgttgaaatcctagcccccaaagtgatgagattagaagggaggattgctgagaagtgattcagtcacgatgggccctcggaaatgggattagtgctcttatcaaagagactaggagcactggcttgcccctatcaccacatgaggacacagcaagaaagcacccatttatgaaccagaaagcaggccttcaccagacactgaatcttccaatgccgtgatcttggacttcccagcctccagaacgataagaaacacatttctgtggtttataagtcacccggtctatggtattttgttgtagcatcccaaatggacgaagacatagttcactgtcagttcaattgaccatgaaggattatggggcctgcgtgtccctggcactgtgataggaactgaggagaacacagatggaaattaataatacttcagcctgtattttaataacgtagagtttagtagaaataaactgaaaggcatagcagggtgaaaaaaaagtgtaagtaatgtactaatatttgttgagccccaccatatgctagactctattgtcttacttatacctctcagcaaacctataagttaggtcctattagctaatttatagatggcaaaataggctcagtgaggtcaagtaacttgccctatgttatagagttatcagtgggaaagttgaaagtggtcaagggctatttatagtcaggagaaattaagcgagtttagagtcattccttttctgtagcattacattagtcctgaaataaagcaaaatgtatcaaattcatataccatatataaatatatatatattttttattattattttaagacagagtttcagtcttgttgcccaggctggagtgcaatggtatgatcttggctcactgcaacctccgcctcctgggttcaagtgattctcctgcctcagcttcccaagtagctgggattataggcatggaccaacacatccggctaattttgtatttttagtagagacatgttggtcaggctggtctcgaactcctgacctcaggtgattcacctgcctcggcctcccaaagtactgggattacaggcatgagccactgcgcctgatcctgtattttagataagaaagatgctttatctgtctcccattggaatacacttttgttgttcgtttttttttaacttaattaaacttgaaagccaacttttgtcaaaacagaagaaaataaagcaattttttaaaaaatccagtatttaaaatacttatcatttataatatatgcatataacagaaaagtagaaaataattctgcattttaaaagcttagcttctacatggcaagtgtgggacataaagttgatacttgactactaactggatatattctagattttcacatttaatgataatggatgtgtgcgtctcatggtcaaactaaaatgatttattttttacaaattatctttatcattagcaaacaagtcttacttttattagtcaattataagtccacagagctataggagctcaatttgttacagggaacttgagcattccatggattatctgagctgaatttgaagaatgtactgtggagatcttctatgtgacatatataaaggatgtaggtcaactactggttattatttagaaaatactttagggaaaaaaattatcttctggggccaataattgagttctattaaactacagaggtagataattttgaaatgagaaatcaaaatatattttgattttatattactcatattttcattttattcataaagtcttttggaaaaagacaacagaaattgtactttgttgagaagactcctagagccaaatagtcacagactcagaacacacagagacaagcaaagatggttccagcaagctctaaggacacagacatgtgaaagaggcgctgaagacacacgaggactgatgcatggtagatgtcattctgatatggctgggcttctggactcactgcctcctccttctagaacccagcacctccaaggctgggagaagagaagtttggggtctatgggaaatgacctctggaagtggctgtgactgtttccaaagacaaatacaatctagattctcaaaacaatgcaaatgaacaaaaaatgtgagtttagcagttagtgaaacattaagatgagatacaggagtaaacacatttttttccataaaagtagtggatgttaaataatgaaatacagtggtaaaacaattacagcctggaggctttaagatgtaaatcaaaaatggagaccagtggtgttaatatcatatgagaggattaaatatgagctgctggtccaactgtgttctgcaggaattcaggcagatggatgagagacaggctatgagtaaagcattaccacagctgggggtgtggtgtatggaagctcatcctagctagcacttggagaagaactcacacattgcaaacatatccggttaaaaactggcatttgctgcaactaaaaaaggcaagtgatggtctaggtgaactgccttttctttctctccttccaaaggacaaaattattattattattttttttgagatggagtcttgctctgtcacccagactggagtgtagtggtgtgatctcagctcactgcaagctctgcctcccaggttcacaccattctcctgcctcagcctcccaagtagctgggactacaggtgcccaccaccacgcctggctaatttttagtattttttagtagagacggggtttcgccatgttagccaggatggtctcaatctcctgacttcgtgatgtgcccgccttggcctcccaaagtgctgggattacaggtgtgagccaccgcacccggccccacaaaattaaattcttaattaaggaaactgtttcttttacatctattttttcatcccaaactcaaatgccaaatatttagctattatacatgtattcattttcttagaatacactctatccagcttgacatttcttttaaattttcccattacataattagattcttgatcctcatgtatgtgatgtttccatcatgtgctgggttttatgctccaaatacatgtcctttcatactttaatggacacaaatgtgctttataaatattttaaaatccattttaaggtaatttattgagtgaaaattctgtgtttggtattttactggggtcagtggtggggtaggagaaggaaaggacatggcttttgccctctaaggaagttgcagggaaactgtctctgatttcattatcaaagcgaggcccctttctatttctccatttcaataccttttctactgacttcagatctatcagatgttataattatttcccacttgtgtttgtgtaactgtgttctgactatccacacattaggtgtgggctctgtgaaagcagggaccatattgatcctgttcaatgtcataccatatccctagcatagaactagtagaggcataacaaagatctgtgaaaaagtaaatgcatgcataactcagttggtcaattaatgtacatcacttggcagaagaataaaaggatcacgagagcagatgaaagaagactttatattttgcagaagaaaattttctgtgtcttcaaatgatcacaaatcaaattaataaagttgatgaggctttcttcaaaatggtgcttgtagaaaaagtgagagaaaggtaaaacaagaggaataatatggatatttagcattctggatgtttgctaagtgacaatttaaccacaagaatacacttcacaggccgggagcggtggctcacacctgtaatcccagcactttgggaagctgaggcaggtgatcacgaggtcaggagatcaagaccatcctggctaacatggtgaaaccccatctctactaaaaatacagaaacaaaattagctgggcgtgatggtgggcgcctgtagtcccagctactcaggaggctgaggcaggagaatggcgtgaacctgggagcttgcagtgagctgagatcacgccactgcactccagcctgggcgacagagcgagactccgtctcaaaaaaaaaaaaaaagagtacatttcactccattgtcaagagagagagatatatatatatatataaaatacatattaaattatgtgtgtgtatatgtatatcttttaagaccaattttattgagatataatttatagacagttaaagtcactaatgttgtgtataatacaattagaattttgacaaatgtgtacatacagttgtataattggtgccaaaatcaagatataaaatatttccattacccataaaaagtttcctcagtcccttttgtggccaatgaatccccatcttcctgcaaccaatggttttctttcagagactatagttttttgttttcaaactttctgtgaatagaatattacactgtgtatttgataattgttttctttcaatcagcatggtgtttttaaattcatctatgttatgtatattactacttcatcctctatttttgcttaacagtattccttttctagctagaaagtagtatcaagatactaaaatatatttgttcatcacttgttgataggcaactataaataaatttattgccataagcatgtgtatacaagctttctgtgagcatatgttttcatttttcctgtataaatttctacaagtgagattttggggtcatatggtaaatcagtaccaaagtattttccaaagtaatgtattatttttcattttcatcagcaatatgtgggagttctagttgttctacatctttaccaatatttggaatcatcaatcttcttaattttagtcattctttttttttttttttttttttttttttttgagatagagtctcgctttgtctcccaggctggagtgcaatggcacaatcttggctcattgcaacctctgcctctcaggttcaagtgattcttctgcctcagcctcccaagtagctgggattacaggtgcctgccaccatgcctggctaatttttgtatttttagtagagacagggtttcaccatattggccaggctggtcttgaactcctgacctcatgatccaccctccttggccttccaaattgctgggattacaggcatgagccactgcgcccggccttgatgacgtctctctttcacttttgttcctgacagtccagactgcacaatttcggatgtgggagactgggtgatttctttgatcttcccaaccaaatatgacttacttaaggattttacctgtaaaatacattattaaaggttaagagaagggtgacaatggtggcctccttagcttaactgaatggttatggtttttagttgtagttgcaatcttatgcttgtgtggttctttgattagtgtttactttctctatcctacactattagcttcatgagaataggaaaattattcctctttgaactcaccattgtattcccaattctagcacagtgcctgggatttcctctgtatgtgtttttgaaatgcacccaatagatccacagacagattttaaaaatataaacatagaaacaaatccttctggtcttgaagcttgaaacttacatttgttttctctgagtttcttcctcaggaaatggactctcagctctctcaaaaagtatcaaagaagtgaaattcatcagaccactgtgtcgagacaatgagatgccagatgccagattccttatttgtcatgattgcttccttagccctccctagttcctgttttcctgctcatagttacatttcttccttgctatataatcccctaatttcggctggttgaggagatggaattgagactgatatcccatatccttagctgtagcatgcaattaaagccttcttccttggcaatattcattgtctaagtgattggctttctgtgtgcaagtaacagaacctagattgaactcctggtatttcagtaacattttgtgtgtaagaaagagggtggaggaaggagagtaggggaaataggaagagtgtcttaatatttttgttgctataacagaataccacagactgagtgatttataaagaaaataaatgtatttagctctgaggcctaggaatgccaagagcatgatgctggcctctggagaaggccttcttgctgcctaacaacatggcagggggcatcacatagtgagagagcaagagcaaaagggcttatgataaggaacccactactatgctagtgacattaatccattcatgagggcaggactgacataaatctattcatgagagaagagggattaagtttccaatctacgaacttttggaggatacattcaaaccatagcagaaagacagacagagatagatatgtaaagagggaacaagcacacatcacacatacaaaaactggacaatatttttataaatgaaatgcctagagcctctctcgtatattgtatttgttgttattttctcaatttaaacttatcactccataatttctctttttcttccaaatgaaaatttcttctcatttctccaaaatgatgtacatgtttcttccttatagccataaaacacagtaattgtttcctggaaaattttaaatgtctcactacaattcaagtatcatacttactatatgttttttatcttctgtgtattttgaaaatgtaagagcattattgtcttatacaaaataggtgctagcagagtgaagagacaaccaaaaataactcaataagaaatggacaaatgatccaaatagacatttttcaaaagaagacatacaggccaacaggcatataaaaaatgctcaatattactaatcattagagaaaggcaaattaaaaacactttgagatatcaccccatacgtgttaggatggttattataaaacgacaaaatataacaagtgttggagaagatttgaaggaaaggcatcatggaaaatagcatggaggttccttcaaaaattaaaaatgaactaccatatgaaccagcaatcccactactgggtatatatccaaaggaaatgaaatccgtatgtcgaagagatatctgcaacaccatatacattaaatcttatttatatattagcccaagatgtggaaacaatgtaagtgtccatcaatggatgaatgaattttaaaaagtagtatatatacacaatgaaatactattcagccataaaaaataatgaaatcttgttatttgtgacaacatggatgaacctggaggacattatgttaaatgaaacaagccaggcacagaaagaccatatgatttcacttttatgtcgaatctgaaaaagctaaactcatagaagtagagagtagactggtggttaccaggagctggacttggggtggggagtggggatgtttatcaaaggattcaaaatttcatttaggagaggggaaatattcaagaagagatctaccgcacaacatggtcactatagttaataacaacatattgtatttttgaaaaaaaatgcaaagaaacaaagtaagtattaaataaaaactggttctttgaagctttggcactgtaatatatgaaggccagaagccacatttatatagttccgtttcttgagcatccaagacaatggatgagatgacagtgttgaggaagacaggtcacccactgtgaacactagattcagcttctccccctgctgtttgactcattctgcagaaggtgagaatttatctgaaggagtttacatatttttatgtgacaatgtattcctgagaagataccaaattctttcttctacatcaaaaatacagcatgaaactgacaagagagcatataaatgatgattttttttaagtttccaggaatatcacatgtatcatattactgaaaagaaaaagagcattttatgccgtgaaaaactttggatatccttgaataatgttgactaaaaacagtgagtttatttagtattcatcgtgtctatatttggagtgtatatttttagtatttgtcatcttgcttatcaaactcctgaatctcacttaaaaagtattttccaaagtttttgaaatttctccaacaaaagaagaaaaaacaaaaaagcaagtattggaagtcaaataggtttgagaaatattatgacacatgtccttcttgcacatcataaagcctctaacacttttcatagtaaaccaataaatgaaactcagacttcttgctttgcttaatcaaaaaattaaagttttccaaacttctttgactacagaatcttttgacaacacaatattgatcattgcacactttgagagatattactctacaaaagtcactgcacagcaccactaaaatatggtgaccgataaaacggacaaaggtcattcagtgaaagtttcaaagcaaagagaatgaatgaatatatatatatatggatgtttactttttggattacagttttcagattatgtttgttttaaataagccagtctgctttcataataattatattttaagccattttctgatgagacatttgtcatcatgagaacaatgtagtaaaagtttgttacactggggattaagatattagagtttccattcaagattccctaatactggaagaggttcacttaaattccatgattctatgagaggagtcaaatctgaggtgcaggctctgcaccttcccaggcctgcaggggctttgcaccttcttgcggaacagttgccagctgttatcgcttcacacttaggtcactgccttcactcaagtcttttttttttttttttttttttaggcagaatttcgctcttgttgtccaggcttgagtgcagtggtgcagtctcggctcactgcaaccttcacttcccgggttcaagcaattctcccatctcagccacctgagtagctgggattacaggcacccgccaccaagcccagctcattctttttgtatttttagtagagatggggtttcatcatgttggccaggctggtcttgaactcctgaccttgggttatgcacccaccttggcctcctaaagtgtagggattacaggcgtgagccaccatgcccggccccaagtcaagtctttttcacagccttggttcaccataaaactaaggtggacaattgtcatggacagaattgtgttgcctcaaatttatgttgaagtcctcacctctagtacctcagaatggggctgtatttggaaagaggacctataaagaggtaattgaggtaaaattaggttatatgggtgggccctaatcagtaagactgatttccttgtaagacaaggagatgtggacagagaccacacacagaccacgggacaatcatgtgaggacacagtaagaaggtggccattggcaagggaaggagagaggcctcagaagagaccaaatgtgctgattccttgatcttggacttccagtctccaaaactgtgagaaaagaaattttttatggctgcatagtattccatggtgtatatgtgccacattttcttaaaaatgatgagttcatgtcctttgtagggacatggatgaaattggaaatcatcattctcagtaaactatcgcaagaacaaaaaaccaaacacctcatattctcactcataggtgggaattgaacaatgagaacacatggacacaggaaggggaacatcacactctggggactgttgtggggtggggggaggggggagggatagcattgggagatatacctaatgctagatgacgagttagtgggtgcagcacaccagcatggcacaggtatacatatgtaactaacctgcacattgtgcacatgtaccctaaaacttaaagtataataataataaataaagaaagaaagaaagaaaaaaagaaatttatgttacttaagccactcagtctgtggtattttgttatggcagccctagtaaactaatacaaatatttttagggacaacaaaccatggactttgttattctagtaagatgactttagcactattacctacttctaccttgaagtggtaaaaaaaggcagtgagaagcatttccatggaatgtataaatcgtgtcccgtgaaacagaattagctaataaggttaacacctgtcagctgtatatgatgctgcgtctccaatctccatccggacagcaaaggggaaggcatggacaggagacctgccttcagaagagcacctgacaaaggggcccacagcctggggacggtgacggcagtagccccccgaggcctgggatcccacagcacaattgtgaagggaaagtcttacttgctgggcccagatgtgtaattttctcccaccactggttttttgtgaaaaattcttctgaatacgtaattttgcccctaaataaacatggtgttggacatttttctgactaggaagttaggatatttgcttttctagcatctttattagatgactttttatgtttgcaaagtcactcagaaaaaacttcatcctcccaacacctccctggaccacagtccccacaaatgacattgaactcacaacataaaggaactcaccactaggtaaataggtgcttgactgtgatttaacacctgaattactaaaattgattgcaataattatccaaagaaaaacagccaagtgcaacagtaacgacagcctctgaactctctccacatcttcttgtggacagcctttgagctctctccatgtcttctctgggacagcctctgaactctctgcacgtcttcttgcagacagcctctgagctgtttccatgtcttctccgggacagtctctgagtctctgagctctttccacgtcttctccaggacagcctctgaactctctccacgtcttctctgggacagcctctgagctctctcttgtttgggacatcctctgagctctccacgtcttctctgggacagcctctgagctctttccacgtcttctccgggacagcctctgaactgtctccacgtctcctccaggacagcctctgagctccctccacatcttctctgggtctcctgtggagtctgatcacctttcagttaaggcatctcctgtgagcaacccagttggctactctgagttctgggggtagctgtccttggtttctctgaattgcccagaaaccaacctttctgttgcccatcgtagtgcctacgtggcttagctggagccctaccctgcttttgttgcccaaccaatgcctatgtgacagggctaaattcccattcagctttaactgcttagttttagaaaacaggatgtctggggtcagaagttccttcttaggactaaactggctgaagctggcaaaatccgcaatggcagcttgacctctgaaaaacctctagcttcattatgatccaatttccatgctaaatgacactcccactggcaccttgacagttgacaatcaccatgacaatggccagaagagaccaaaaacaggcagaaaagaggtggctctttgattccaaaaaaacctacctcccttcccaagaaaagctatgaatatttctccctttcctctgtatacccagccccttcattaagaatcctcagttctcaggctctgagaagttgatttgcaggctatgctcccacttctgcaattccatggccattgaaaaaagcccacactgtttgatactcactctcggtttggtgtattggcttcacaccaaacaagaaagagctcctttaggggtagtcaggaccctgattatattcccacatagaaactgttcccactcactactggcacagcagaacacataaactgtcagatggctccatttcaatgatttgacttgtaattctcaattgtttctgttcctaagattttaggactttctatcaactcataaaaaaaattttaaaaaggtaaggcaaccttcaaatctaagatgctcagctttaaactagtaagttcttaaggatgttttttttcctccaaggaaacaattctcctctttgctgagcaataatacaggttttaatattaaataagtacacaaagtaaaagaaacagacaaaaatgtcttcatagcaaggctgttaacagatttctttctttttttttatttttgagatggggtctcactctgttgcccaggcgggagtgcagtggcacaatctcagctcactgcaacctctgcctcctcagttcaagtgattctcctgccccagcctcccaagttgctgggatcacaggtgcctgccatcacgcccggctaatttttttgtatttttagtagagacggggttttgccatgttggccaggctggtctcaaactgctgacctcaggtgatccacccaccttggcctcccaaagtgctgggattacaggcatgagccaccgtgcctggccagatttctaatatatgtaaagaaaaaagaaaaattttcaaatacttgtttagataagtactgatatttaaaaaaacaaccaagcctaaatccctagatttacaatttttaaaaaataagaaaagcaatgtaattcacagaataaaatcttttggagtaaagtaatataactctaacaaattggtaaatctaggcaagaaatgacttgcccaagtaacagacctagtaggtggagagctcatctgactccagaaaccacactctacaaaataaacttattgacgtgaagtatgtatataatctgtaactggtgtgaaactgtggcagaaatacaaagagccgtggtcttgctcatgatgttcaaaggcaatatttgaactgagggatggctgtgtgaattgaagtggtcactggagaaacgtggttgagattgtgaaccatggggaacagggggtggtaattctggatttttggcatagaggagaaagaaagaactgcaaacatcattacagtgaaggagggtgaggccctccgaaaactgattgcgtttcaccagaaacactgatccagtgggggcagctgaagcacgaaaatgattagaaccagagtgatgtcacccacgtttctttctttttcttcttttttttttgagacagagtctcgcagtctcgctctgtctcccaggctggagtgcagtggcgccatctcggctcactgcaagctccgcctcctggggtcacgtcattctcctgcctcaggctcccgagtagctgggaccacaggtgcccccaccatgtcctgctaatttttttgtatttttagtggagagggggtttcaccgtgttagccaggatggtctcgatcccctgatctcgtgatctgtccgcctcgacctcccaaggtgctgagattacaggcgtgagccaccgtgcctggccgatgtcacccacgtttcttaggaaagacgttagcatcctctaaatcctcaccgactgtgcctggcgcagcattattttgcagttttctgggatttacagttggcatcatttgcacagcggcagcgtgacgtggctgtggagagcacggaagatctgtccccacggaagtgggctcttctggttgcaacatggtggaggccagcccggcctcaggtgagggaagatgccacagcaaacctctgagcaaccaagatgacaagcacctgcttggaaaaggtgacaagccacaaggccataggcccagttataaggatgaattgtgttacacgaatggttataaacctgaccgacctcagaaggtatatggaggaggcaattatcaagccccttgatggtctgtggctggatgcaccatactttgccaacagtgtgagcatggcagagaatgtaggtgtgtatataggggaaaacctccagaaagttttttctgtgggagttctttgtaaaataataacaatgcaactggaattatattgcaatctataaagggaaatcactcttagggatcaacattgtagaaagacaacttgttttttgcttctttgctcagtgttaagaagtcatcacatcattgtcaccctccccacattctgttctgtagtgcccgatttgttgaaagcagtatgaggcctgttttaaacataaatctattctaaatctaaatttgtaatacattctgaatgtcatttagacagtcttttgcctggagattaaaaattactttatttctagcaaagtgctctgaagtaaaatattttaacaacaaagaagatctgtgtttgttgttttctccattatctaattattgatatccatttcatctgggcacatataaatggtaaaaatatttacaagctttgaattaggtgaatctaattaaaaataaaatatagatgttaatagagcctggaaatattgtcaatatctttttaatagattgagccccgttgattatttcttctgggataaaggctcaaatttattctgtgaaattagacactcaaatcatctgaggcaatatatggcagatgaatatacactgattgatggaaatgttgctttaatgcacattgttcattgcaattttgcgtaggttactgaactatgaattactattgaggaacagcacattcaacgtgtcatagcaatcaactatttagtatggacattttctatgtttctagattttctggccactctgagcaaatttaaatcaaatgactgaagtataatcacttattttaactctgttaaaacagtcaacttgaaaagtatatttttctgtatgaattttttttctaattgactctattttgttctgataactaaacttatttaagttgcgctgttgaaaaaaactataggccaagcgcggtggcccatgcctgtaatcccagcactttgggaggccgaggagggtggatcacgtggtcaagagatccagaccatccgggctaacacagtgaaaccctctctctactaaaaaaaaaaatacaaaaaaattagccagtcatggttgctggcgcctgtagtcccagctattcaggaggctgaggcaggagaacggtgtgaacccaggaggctgagcttgcagtgagccaagatcacaccactgcactccagcctgggtgacagagcaagactctgtctcaaaaaaaaaaaaaaaaacaacaaaaacaaaactatatatatatatgtatatgtataatctgaagatccatgtcgattccattattttacaatgcagtgacattataaggaagtggaaaaattaagtcaaaattttttaattatgatgaatatagaaaggggatttcttgttgaaacaaataggctaaaagagccttgatgtcagctatgcctctcttagagaaaagactgtgaccctgtcatcccgttggataatctagtgatgcgctttaacagctattgttaaaatagattttaccaaggcaaggacaacagtttgcttatgagcaatgagaagtaagtagtcttaccagagtgcaccctttggaaagtgctgcatatataattagtgaggccattcataattcatttttattatacaaatgctgattaaatgtataccttcttccactcaaatgttaacgtgtcccttcctcaatatattttattaggctatgtatatatctcaagcatagattaatttgttttgtaagatttcaaaacattccttttttagccctgtaatgaatataaaatggatccctactgcccatcttagagaatgcgtgtttcatagaactgtttaaaaaataaatccttttaaattgcccatctgcttaagctatgtttgtggaacattaggactaagtcatgtctgacaaacatgtgtcatactactatttgagagcattactgcattttcaggaataaaataatattattaagaagtataatttttccaagtgatacaataagaatattgctagagatttgacctatttgtgaaaaatctttgcatgattattagcttcctaaaaataaaatgaactctgcaaatgtgatccaagctgttctgtatgaaattatgtgctagttgcacagtcccctgggagaccagtgtgagtccagatgcctctttgctggtttgtttcatttctggggttcattttctagaggtttttatcatattttcaaagtacagaagtcaggcatctcaaattcaagtcttgtctcccccaaactttaaaaaatatatgacattgatataatttggctggataataacaaactgaacaaataagatattttctttcattgaaggttggtaacattttcctcacttaaaaatttttggttgggcacagtggctcatgcctataatctcagcactttgggaggccgaggcgggtggatcacctgaggtcaggagttcgagtccagctggccaacatggtgaaaccctgtctctactaaaaatacaaaaattagccgagcatggtagtgcacacctataatcccagctactcaggaggctgaagcaggagaatctcttgaactccagaggcagaggttgcagtgagccaagattatcccactggactccagcctgggtgacagagcaagactccatctcaaaaaataatttaaaaaaatgaattttctaaattgtgggtcagaattcaagctaatggaaacctgtggaagaaggaattttgcaggtctgcctgtggaatccataattcttttcagaggcagcgatattacaaaaaaaaaaaaaaaagtgtgaggatgtccccaagcagaaaaccgccttcactgcaatgctgacagtatctgggtgtcccagggttcctggggagtgcaactgttatcccggctgtgctgctactgtgctgagtggttttatatccactgagaaggacgtgtcaacaggtggctgctcaggcccctaaagaatggatggatgtgaggtctctgtgaagcctctgggccagatctctgaggagtatctgtaaggggcatctcacctatggtgaggatgctgtgtgagcgctgcatgggaggcctcagtgccaggctcctggtgagaactctgagtgaggtctctgtggagcctcagtgtgaggtttctgcgtgagttctgtgtggaaagtctctaagaaatccgagtcagtttctgtacgaggcctgtgaggccacatgaggtctctgtgggaggactccatggggcagcaagagggctccattgcctcttgtgaggcctctgtatgaggcctttgcagaaggtctgtgtgggaggtatcttccagaggtctctgtggggtctctgtgggaagtccctgtgtgaaatctccgtgctaggtctctgtgtgagggaccatggactatatgaagtccctgtgtgaggaccctgtgtgaggaccctgtgaaagccctacagaatctctgtgtggaatgtttgagggaattctatgtgagaggtttctgggcaatgagtgtggagcaacctgaggcctgtgtgaggaatctatacaaggtctctgtggagagtgggaggtctccaggcaaggtctctgtgtgaggaggactctgagagaggtctctgtgaggcagtggggggtgccatgtgccatttctggggctggaggccagaggttgcagtgaactgcatgagtctctgcatgaggtccctgttttatgactctgtgtgaagtctctgaggtctttgtggggtctctgtgtgagatctccctgtgagaaccatggaaggtctctgacatttgtgggagatctctgtgggactgagtgaagtctctcagcgtggcctctgtggggttctctgggtgaggactctgggaatctctgtgctaggtctctgtggggcaccatgaggactctgagagctccgtggggtctctgtggaggctgcagtgtgtctctttctgtggcagtgagaggtcccagtgttctcactctgtacgagatatctctgtgaggttcctgtgggaggtctccgtgggtctctctattgttggcctcactgcatgtcatgggagactgagctgcagaagggctaaggggttgttgcttcctgtgttctttctggtctctcagcattgcctgtggcgcttctcctggtctgagccatgggctccaagtccagctcctccacatcccagaactcacgtcttggtttcctgagggaacccagcagcagccaggcatggcccatcctcagtggtcagggtcccagctctgtgccacactctcctgagctcctggaggaccggggctgctctctgctccaggtcccagctcctcctgctgatcctggctccgctgtcaccgctgggcccaccttggaggctgcttcagttatccaggcctcagagaggacctggccccaggagaagccacaggctggggactgtgcccactgccccctgcaccccggtgccggccagtcccacatgttgggggcagggccatttccattgtcatctagatcagtggcactgcctggcactggcctctccaccattgaaatgaggcccccggaagtgggcctcttgcacgcctgtatgtggcacaaggcagagaaaactccctctagagacctggctcctcctgtccatgatttgtggagacctcctgctttcccatatggacagggcccagagaggaggaaagctgtgctgaaagcagagggagacagcagggacggctcctgtcctgcccataccctgcccattctggacaggtcacttccagctcccttgtatgttcaaatcctgcctgcctgcatcttcccttgctggtctctggggcaagcaaggatgtcaggagccagggaagatttgctgtgtgaccccagctcagctgctgggccctagtaagtcaccacctttccccagggagcagtcctggggctacgtgtatattaaaggtcaccagacttcgactcatgcctggggttctctagtccttgcttttccacctgttgtcaacacatcctttaaaaaattcaataagtaggccaggcaccatggctcatgcctgtaatcctagctctttgggaggctgaggcccgtagatcacctgaggcaaggagttcgaggccagcctggccaacatagcaaaactccatctctactaaaaatataaaaattagtcgggcatggtggtgggtgcctatcatctcagccacttgggaggctgaggcagaagaatcgcttgaacccaggggccagagtttgcagtgagccaagattgtactacttcactccagcctgggcaaaacagtgaaactctgtctcaaaaaaaaaaaaaaagttcaatagattattatgtgcaagcttatcgaagatgttaagaaattcatcttccttattcacttcgccttctcactaatatggccctctgtgttgggggtaaatgtggtttttctaggggtctgtgatctgggagctggagcagagacagaccctggggtgtggccaggatgagacactaggcccctctaggcctatctaaggggttggaatgtcagagtctcctggctcacggcaccactgatggctccctcacacacgccactttgcctccttttcaattctctgtctgcatcccctgtagctctacagagtcccaccatcagaagcctctgcacacacaggcataccctactccattcacccagaactacttcactgaagctgagagacatgtaggtgagatagacaaaggccggtgacccaggagcagggtcattcactcatctggggcaggggagttcacggccctcagcaacctccataaaggctgcccccctgaccccctagcccccacctacacatgcacagagctggaaggtctgtccccactgccactccagagtgcgagaaagggagaggcagtgggatggggactctctgcttcgcatgttggctgagctaagagggcccatctccatcccagcctttgtcagggagagaaggggcttcccaggggcagacgttatctattctccaccaggatacccagggtcaagacttctcccacttctgaactcagggcccagcactctcccacccaaacttccactattttttgacacatgaaggtactcggctgtggcacttcctggagcctgcatggagatgttcagtcccgtgacatctctgcaaaccttctccctacagctgcatgaagtttgaggtagagtaagtagtggaaagatgggttgaaccttatttcagagtgggaccttcataggtttttctcatcttgtttttagaattttttgttgtttgtgtaaagacgatattacggaaacataaggttcagtgaaggaactcaggatgaaggtgggcttacagcaccactgtcaacatccctccatgtcctgtcgcatctggaaaccaagcccacaccaagcatggcacaaatagaagccatcaccctcttataaataaaaaaccatatatattgtggaatattaaatgttctgcatttactaacatgagagaaaatattttttctctacatagagtgaattttttcttggggacttgtttttctccagggaaggctaaaaaagaatttgtgactgaccaaatcagataccttcccaaagaagacagtgccttggacagtggtgatggtggctagaggcaccggatgtcttcggccagtgctgagggggactgactggggatacagctttcttggggtgcaagatttggggatgtcgcaggccccattgctcattgttgcaccgcacacttttcaagggctgttgatttctgatttgcctgtctctgttgggacaaccctggctcttgagagtggcttgttgactgctggctgcatagctcagtattctgccatgttctgagtagaagaggtgcctgtggttgcagggaaacccacagactggggcttgaaacttctgtttgtgctgatttaccttcgaggcatggtgcgcatggcaaagtgacattttcttgtccagcatttgtccaactgccgtcatgagaccctgagcttcagcactgctgctgtacacacatgatctgttttttactgttttttggctctcagcagtgactggtgctggcttgctttttttctttgaaaaaatccactgaaaaaattgcttgatgttttctccaaagtggcttactgaaggaggctgtttctttgatggcagtagctggacgccttcatcctgatgggtgtcttctgttttcctgactggggtaagttgaggagtcctcaatccttcaagcctttcttcatgtttttctaagttgggcttcctagacttctcactcttgtgaatagggggaaacattggcctttggctcttgcatgagccttgacagtttgggtttctgggctcctcttgcaccagtttgctccttctggctgccatgaggtcatgtagctcctgggaagcccgcatgttcccagtaggcatgctctggagatggccctggggcacttgagaaaccaaattctctgaagcgtggggcacaacagatgcttgcccatctggaaggagcacaacagcggcacaaacttgaggctgggtctctgactttgtggccattccaggctcaaattcactaacaacctcctccataagacacagctttcttggatcttgggagacagacactctagggtgtagagagcttttgctggtccctggagcctcgaaaccatgcacatcctcacttgtggcttggaggtttgccagcatacaggtttccaaggggactctgcattgtggcactgcctcccttgtctctccagcctttgaagattgggctcctaagctcctgctctgctgggtgctgcctgtgaggctgtacgtgaggggcttagatggccacctgccctcctgtccagctggaggaggcttcaagggcccatgatcattccaagatgggattcctcgcggtgccctctggaactgcttccatgcaggtgaggaggccagaagactctctggcatgtgatcagatgctttggtcagcacctgctttctcagacttgccattggtggctttctaaggaacatgtccacctcaacttctgagccagccccagattcacaggtggctgaggagggaccagcaagctgcgtaagggacaaggatgaaaccttttccagtttaaagcactgaatgggcttgaggaccctgaggggtagaccccacctgtgtttggcccaaaacctcacaatatgggctcccaacccctgctgagtacacggctcgaggaaggaaagcacctgggctgtgttcacacaggctttcccacttttcggggctgctagattgctggttttcacatgggtgttggacacgggaagagcctggttgacagcaagccaggatcgacgcacacgcacggggatcaagccctcgttggtctggcccaagttcctgcccatgtgggctttcaggatgttttctatatgagtcctctctgtgcatcttaataaatcacttcccgagtcactcctcaagggcttcctcaagttcctttccgactcctcagaagtcacccccagaaccttccgtgggaagcttttcatgtccctggatagattttgtggggtctcacccagaatttgccccagatgtgggcacaggtccctctctagctggaacttcaccttctgtgcctccttgctgctttcacctgtggacgtggaggactgccagggactgggtttgcccttggcctgacttgtccctggtgattcgtcccgaagctgcatcagatccagagactcttggatccttcccaggttgccccagtgttggatgatccacttttttatgtgttgctccagttgtctccggagttcaggactgactggaaagttctcaggcagaatggatgtcaaactttcctggggaaggttaggagtggagacactaaagacgtcctgagatttttggaccctagagggtaaagccaacctaccttctagttgtttcctcaacaaaggccattcagggtgctgagtttcaggtagggagagagcttgcactttattctgcgatgcagggcaagctactccagtgttcttaatcagggatggaaaagcaggagataggactgggaaagaagactgaagatgggcctgagcctcggcctgagccataggtgtgggcaggaattggggtgtggatgaaataaagggttggcggtgggacaggggctgggcctggaaaagcagtggggacattgtagtctccctttgaattgggcagacattggacatttcattgaacaagaaaggaggagactgtaaagtataagacctgtcagttacccaggcgttagccaccagggactcgctgtgcagagaggggaggccccagaaaagctggctataattcttccaaaaactttcctgcaagagcctaggatctgagcacttctgaggtccgggcagctgtttcgagttctctcccatgttccagaagggttttgggtttgtggtgtcctgctcagcatccaatgatttagccaaattccccaaagaatttaagtgcttttctggggtcatttgatttgtaaatgatccaacattttctttttcttcccaaatgttgaccttggctgtttctgtgacttgtatccccacgacattctggccatcagagctgagcaaaaacaggctaccagcttccatctgacaggtctctggtgggtggcgggaaagaggatcttgctggactgatgagttaaaggcgcacgaggttctggcagtctcctgccaccgggaggaggcagaaacatgactgtttgagccaccaaggcctgagatggctgggacagaagccaccaaatcctcatgtggagacaagctttgagggacggtgcccagtggaagtgccactgagtcacagtgagatggagttatcagtgtggagtcccgcaggggaggagcagtgaagccttttggaggaggcggagagcaggccagaggatcaggggtgtgtggtgggtgagggaaaagtgcaggtggctcgggtgaggggtgttctaggggaagggaaggttctggtggctgggaggcacttagggaggagactgaggtggtcattgggcctggtgatggggtggaggccagatcctgaggatgcttggcttgaggatccggggaagctaacggggagagaatgggagcagcatcttccataggctcatgagaggactgggaggctccatcaggtgctctttcgcccacctcacctggggggtctggaccggagagctgaccaaagtcacctttgtcaaggtgtggccccaggaggctgcaggagacaggaggcacgagctgcagccaggagccggtggggccggagggcagagtgggtgctcgggccacagcccctccaccatcccacaccctgattgcccaattctcctgctacccctcgccccagggttttactcccatcctctgtccccctggtctccccatcccaggtcagctccaggctgcctgtggcccttgggtcatgtcccagccctggtaggaaggatgcagggaaggggaagtgcctcacctctgcagttgtgaaagaaggtccgaagtctcctccaggcctctcgggcactctctaccagctggaaatcaggagactgggttagggcagtgagggaggggcctgggatctcacaggaggctgagtggctgtttctttagggaggaccatggggaattagaccctggaccccacccatctgtgtccaaagccacatgaccccgacgttaatagcaaggcatggaggacagggctttttcattcacaacaggcttccacacacggaccccccacccccacagtcctcacaactgccctgtggggagaaaggactgaggtggtctcaaagaggaatcagccttagcagagttggacagctgttcccagggagcgggaggccccctcacccccctccgcatccaggcaggcattggtctccccaggacacacacactgccccctgctgggtaacgcccagtccctggcccaccatggcttcattcccgcatggaatctgagaaggacccggggttctgatttccttcctaggagcccccacctcaggcttcttcaactgacttcttcagagtcagttccctccgggacagatgagatcaaattaactctagtgtgctctggcagagccttacctctcagactgtggtttttcatcctgcctctgggcctccgcctccgccctactggacactgggagacatgatgacgtacggagacaagatgacgcggagagacaagatgacaatgggagacaagaaagggcgagaagctaggactggctctccctctctgctccagcccagccgcagcatgctgcactcaggaaccgcatgactctctctgtcttgctcagggagctctgtgtgcttcctcccactcatgtttaactggatgataaactgcttttcttcttagaaaaacagcaagagggggctgggcgtggtggctcacgcctataatccaagcactttgggaggccaaggtgggttgatcacctgaggtcaggagtttgagaccagcctggccatggtgaaaccccgtctctactaaaaatacaaaaattaggcaggcatggtggtgggcgcctgtaatccccagctattcaggacgctaagacaggagaatcgcttgaactcgggaagcagaggttgcagtgagcctatatcactccatttcactgcaacctgcgtcacagagcgagactccatctcaaaaaataaaataaaataaaataaaataaaataaaataaaataacacacaaataaaataaaaataacacacacacacacacacacacacacacacacacacacacacagagggattttcaatatgaggtccaccacggacaccttcagtccctgttcctctgctccaggaacacccaagttcaggcccgcaggcactgctgagctatcaggtaggattctgcttcccagaagaccagaggagacaccaggccctggtgggaggccctcgggggcccagcacaggccccagatcaccccacacaggggaggctgggccctgagccacctgccccagaaaggggctgatgagccagggctcagggcctggtctcggacagagacctccccagtctcatgactggtactggtgctgagtccactggtttgattttgccttgatgcctcctgtgctcccccacagatggactgagatcttgggatggaaatcccagtacactatctacccctaccaacccctggctgccctgcctctccctggaaggatgatgttctggtctcttctgagacttcccatcatagaaggctctccactggatttggaaaagtggaactaataataaaaagaaaggagagaatcaagctctgtgggtcgggactgagggttccttacctttctcttcccaggcgatggtgagggtgggtcatcacaatggaagtaagataagtaggggagtaataggaagaagaaccccagggcaaacaccaaggtgaggaagatatccaacacccatggtgtggagctgggggcgtttagcgatgaggcactaagtaattttaaaggaaagggaagattctccatgtgaataggcacgttgctttcaagcaactgagctctgggcatccccgtggagactagggactggggcccaggcctgcgtcacagaggtggggccttgatgtcacaaagggctcctttgttggggaggggcagtgggagggggaggggcagagggagggggaggtgcagcaggagggggagggggagggagaggggcaggggagggggagactggagcacagcccctccccacccccaaagctggggatccctccaccatcccaccttctagatccctccttcccactaagttttgtcagtgatagccaattttctattctttctccctggaatatagatattacctggttccttttatctgttggagacggtggcttgaggttacctattttatagcccttgaaaatctgaagttctgaaattttggctatgaaccagggattttcattctcagaatctcgttcatcctcaactccagctttcccacactatgtttttgtcttgtatcaatccagggacaaaatgtaaatttcttttactcttatttagttttgcaaattttgaatagtaagttttaaaaaattatttctatctcactttcaatcaaagggaactacccacatacaattaagatttttttttgtcttttaaagttttatttatgtacttatgtatttattttattttaactttcaggatacatgtgcaggacatgcagttttcttacataggcaaatatgtaccatggtgatttgctgcacctatcaacccatcacttaggtattaaacccagcatgcattagctatttttcctgatgctctccctaccaccagccctccctcgacaggtgccagagtgtgttgttcccctcccagtgtccatatgttctcattgttcggctcccacttgtaagtgagaacatgtggtatttggttttctgttcctgtgttagtttgctgaggataatggcttccagcttcatccatgtccccgcaaaggacttgatctcattcctttttatggctgcatagtattccatggtgtatatgtaccacattttatttatccagtctatcattggtgggcattgggttgattccatgtctttgctattgggaacagtgctgcaataaacatacacgtgcatgtatctttgtaatagaatgatttatattcctttggatatacaataatggtatatctgccacagcctctgtactgcactgtggggaattctgcccagtgcaaaccacccagtctccctagcactggcgggggaaaaccaccggctagacccgcagtaatggcggtcacccttccccccaggaacttggtcttcttaggcagactccaggtgctgtgctggccagtggggattccatgctagtgggtcttagcttgtggggttctgtgggagtgggtctgcttggctccctggcttcagcccccttctcatgggagttgatggatctcctgcttcactggatttctgcgagccaccagagtatgcagaaactcctacagctcagtacctgcccaagtggctgccagctggagcccctgctatgggtctgcacagctttgtgcttgggacccaaggccctggtggtgtggactcacaaagggattacctgttctggggtttgcaaaaatctgtgggtaaagcacagttccctgggtgggtagcacaatccctcactgcctcccttggctggaggagggaggtctctttgccctgtgtagctcttgggtgaactgtcacccaactctgcttttccttgctctccatgggtcacaccaactgcctagtcagtcccaatgagggaatctggatacctcagttagaaatgcagaattcactcgctgtttatgtttgtctcagtgggggctgcagagtagagctgtttctactcaaccatcttggcccctccccccaattaaaataattcatatttaaaatttgtaattctaattatgaaacagttataagtagttaaaccttcaagtggtatttctgtaaatgtatagcatttacagttctggacttggtaatgcttaaagtgcacgataacttatgggactgctacataggcatacctcagagatactgtgggtttggtttcaggccactgtggagatgagctctttagggcagtgcccaatggaagtgccattgagccacattgagacggagtcagaatgcagtccagcagtgggggagcaatgaaggcttttggaggaggtggagggcaagccagacaatgggggtgggtatgatgggtgaggggaaaatgcaggtggcttgggtgaagggcgttctaggggaagggaagattctggtggccagttctgcaataaaacaaatatggcaataaggcaaatcacacagaatttttggtttctcagtgcatataaaagttaggtctatactatactgtagtctattaagtgggcaataccattatgtctaaaaaagtcaatgtacataccttagtcaaaaattattttactgtttaaaaatgctatcgatcacctgaatcttcaacatcaatatctttttgctggtcagtggccttgcctcagtgttgtggctgctgactcatcatggtggaagctgctggaggtgaggtggctgtggcaatttcttaaaataagacaacaatgaagtttgctacatcagttgactatttctttcaagattcctctgtagcatgcaatgctgtttgatagcattttacccacagtagagcttccttcaaatcggagacaatcctctcaaaccctgccactgctttatccactaagtttatgcaattttctaaatactctgttgtcgtttcaacaaggttcacagcatctacacctggagtagtttccatctcaagaaaccactttctttgctcatccaagttctcatttgttaaaattttgtcatgagatttcagcaattcagccacatcttaagatctcttcacatcttttaatcttagttctcttgctatttccaccacatctgaagttacttcttgcactgaagtcttgaaccctcaaagtcatccatgaggattggaatcaacttcttccaaatttcttttaatgttgatattttgacctcctcccatgaatcacaaatgttcttaattttaacctcctcccatgaattgcaaatgcttctagaatggtgaaacctttctagaaggttttcaacttactttacccagatctatcgaaggaactactatacatggtggctacagccttatgaaatgtatttctcagataatcaggcttgaaagtctaaattactcattgatccctgggctgcagaatggatgttgtattagcaggcatacaaacagctttaattttcttgtagttctccatcagacctcttgggtgaccaggtaaattgtcaatgaacaataatattttgaaagagatctttttttaaagcagtagttctcaggtgtgagcttaaaatattcatgtcgtaacagatgtgatgtcattcaggctttgtcccatttatagagcacaggcagagtagatgtagcatagttcttaagggccctagaattttcagaatggtagatgagctttggcttcagcttaagcccctaacaaaagagtcatcctgttctttgaagcattgaagtcaggcatttattttgctacctggctgtaaaagtcctggatgacatcctcttccaatataaggctgttttatctgcagtaaaaacctttgtttagtgtagccacctttgttgcttctcttagctgatcttatggatgacttgctgcagcttctacatcagcacttgctgcttttccttgcacttttatcttatggagaagacttctttcattaaacctcatgaaccaatctctgctagcttcaaacttttttctgtggcttcccaacctctctcagccttcagagaattaagaagaattaggtccttgctctcgattagggtttggcttaaggaaatgttgtggttggtttgatcttctatccaaaccactcaaaccttctccatatcagtgataagtctctttcactttcataccactcatgtgttcattggagtaatacttttaatttccttcaagaactttttcttttcatgcacagtttggctgttaggtgcaggaagcctagtttttggcctgtttcagcttttaacatgccttcctcactcaccttaatcatttctcacttttgatttaaataagagatgtgtgactcttactttcacttgaacacatagaggcctttgtagagttattaattggcctaatttcaatattcctgtgtctcagaaaacagggagacctgaggagttggggggatggaggaagggcagatagatggaaccattcagacacatatatgtatcagttaggctcattgtcttttggagcatggtttgtgatgccccaaaacaatgacaatagtaatatcaatgatcactgatcacagattaccgtaacagatataataataacaaaacatttgaaatattgcaagaattacaaaaatgtaacacagagatacaaaataagcacatgctgccagaaaagtggcactggtagacttgcttgatgcagggttgccataaatcttcaacctgtaaaaaatgcaatatccgagaagcataataaagtgaagtgcaataaaacaaggtaagcttgtatatgtatgcatgcacacaccagtatgcatccacctatccacacacaaatctttgtacaaacaaatcctgtattttcaattccaacaatacatcatttgcaccttaaaaatatctgtcaaccttgtagtatccttttctgtctttgttatcagggtaatgctggtctcataaaaaatgtttgtgttccctcctcttcaacttttggaagagtttgtaaagaaatggtactaattcttctttaaacatttgctagacttctccactaagctatctggtcttggattttcctttttcaggagctttttgaccactgactcaatatttttactcattatttgtgttgattttctatttcttcatgtttcaatcttaagggatgtatgtttctagaaatctctctatttcttctaagttaaacaatttgttgacacatagttgtttagactattattatcctttgtatttctatggtaccaattttaatatctgcttttttgttctaattttatttatttgaggcttctctcttttttcttagcctagtgaaaggttggtcaatttttattatttttattttattttattttatttttttgagactcagtctggctctgtctcccaggctgtagtgcagtggcgcaatctctgctcactgcaagctctgcctcctgggttcatgccactcccctgcctcagcctcccaagtagctgggactacaggcgcacgctgccccgctctgctaattttttgtatatttagtagaggcggggtttcaccatgttagccaggatggtcttgatctctgacttcgtgatcagcccgcctcccaaagtgctgggattacaggcatgagccaccgcgcccagccattatgttttcaaaaaatcagctttttgtttcattgatcttttctattgtttttctagtgtatttcatttacttctgctatcatcttcgttatttccttccttcttctaattttgggcttcattttttttcttttctatttctttgaggtttattgtttatttgagatcttttttcttcatttagcacttaacctgtataaacttccctgttagaattgcttttgcttcatctcataagttttagtatgttgtgctttcattttagtttgtctcaagatattttatttcttttttgatgttttctttgatctattggttgttcaggagtgtgttggttgatttccacatatttgtcacttttctaagttttctcctgtttttaattttcagtttcatgccactgtggtcaaaaagaatacttgataagatttcaatcttcttaaatttgctaagacttgttttctcccccaatatatgacctgtgtaggagaatgtactgtgtgtgctcaagaagaatgtgtattttgctgttttggaaagtaatgtcctgtatatgtctggtccatttgatctatagtgtagttcaagtcatctgtttccttattgattatctgtgtgagtgatcaatccattgttgaaagtgggatatggaagtcccctactgttattgtattatcgttgtcacttctctcttcagatttgttaatatttgctttatacaattaggtgttccaatgttgggagaatatatatttgtagtaattatatcctcttgatgaattgacccttgtatcattctataatgactttctttccctcttgttacagtttttgacttaaagtttattttgtttgttgtaagaatagctactctttcttttttttttgttccctgtctttcctttcagtctatgtgtgtctctaaaggtgaagtgaatctcttataggcggcatatatttggttattgttttactgtccattcagccaccctgtgtcttttctaatttgatccactgatatttaaagtaactattgataggcatttcgcagtttctttgttcttttatttctctcttgctgtgcatgatttgattattttgattattttctgtagtggtatactttggttcttttctgtgtctttgtattaattcttttttaaacatgtggtaaaattctcatttgtgtaactattacatgttttgtctttgtgattatcctgaggcttccataaaacatcacatgctctcatctgccacataaggatgttttggtcaatgatgggccacatatacaacggtggccctgtaaggttataacatttttattgtatcttttatatgtttagatatatttggatacacaaatgcttatcattgtattatagttgcctatagcattcagtatagtacaatgctgtacagatttgtagcctggaagcaataggttataccatatagcctgggtgtgtagtaggtggtattatctaattttgtgtaagtatactctatgatattcacaccatgacaaaattgcataatgaggcattattcagaacatatccacattaagaaatgtatgattatagttataatggtctattttaagttgatagcaacttaacttcaagcatatacaaaaccctacactttactcccctccactttttatgtttttttgatgtcagcgtttatttctttgtttattttgtagttatatttatttgtaatattttatgtcttttaaccttttaaaagttaaagtgattatactccatcattacagtattaggaatattttgaatttgactgtttagttacttttactggtgactttttataactacatatgttttcgtgatgctaattagtcttattgcatttcagtttgaagaactccctttagaatttcttataaagcaggcctactgacaatggactcccttagattattttggggggtttctgaaaaagtctgtaagtcctagccagagcaattaggtaagaaaaagaaataaaaggtatccaaactggaaaagaagtgaaagtgtctctatttgaagatgacatgatctcatatagagaaaattctaaaggctccaattaaaaactgttaaaattaagaaacaagcaaatttgcagaacacataattaacattaaaaaaaaacctgttacgtttttatatactaatagttgagtatcccagaaagaaattaacaaaacaatctcgggccgggcacagtggctcacgcctgtaatcccagcactttgggagtctgaggtgggcagatcacaaggtcaagagatcgagaccatcttggctaacacggagaaaccctgtctctactaaaaatacaaaaaattagctgcgcgtggtggcgggaggctgaggcaggagattggcgtgaacccgggaggcagagcttgcagtgagccaagatcacaccactgcactccagcctgggcgacagagtgagagtccgtctgaaagaacacgatctcatttacaatagcatcaaaaaattaactacttacgaagaaatttaaataagacagtaaaatttgtatataccaacaactataaaacactgatgaaagaatttgaagaagatacatatccctattactcagtgcgatctatagatgtaatgcaaccccatcaaaatttcaatggcatttttcaaagaaatggaaaaaagcagttctaaaatttttatgcaacctcaaatgaccccaaacagtcaaaacatccttcagcagaaaaaacaaaagtggaagcatcacattaccttattccaaactaaattataaagctatagtaatcaaaatagtatgctactggcataaaaacagacatgtaggccaagggaacagaatagagatcatagaaagaaataaatccatgactttacaatcaattgatctctagcattggtgccaagagtacacaatgataaaatttagtctctttattaaatggtgttgggaaaactggatatccacatgcagaagaatgaaactgaacccttatctcactgtacatacaaaaattgtctcaaaatggatgaaagacttcaacataggaccaatattgtaagactcttagatataaatatcggagaaaagctccttgatactggtattggtaataaattttcagatttgataccaaaagtatagacaacaaaagcaaaaatagacaaatgggagtaaatcaaactaaaagcttcagcacagcaaaggagacaaccaatacaatgaaaagataacctaaagaatgggagaaaatatttacaaactatacatctgataagaagttaatatccaaataaattaggaactcagacaattccaaaggatcttgtattagtctgttttcatgatgatgataaagacatacctgagactgggtaatttataaagaaaaaggtttggccagacacggtggctcacgcctgtaatcccagcactttgggaggccgaggcaggcggatcatgaggtcaggagatagagatcatcctggctaacatggtgaaatcctgtctctattaaaaatacaaaaaattagccaggtgtggtggtgggtgcctgtagtcccagctacttgggaggctgaggcaggagaatggcgtgaatcttggaggtggagcttgcagtgagcagagatcgcaccactgcactccagcctgggtgacagagccagactccatctccaaaaaaaagaggtttaatggattcacagttccacgtagctgggtaggcctcacaatcacagtggaaggtgaaaggtatgtcttacatgacagccagcaagacaggatgaaagccaagcaaaaggggaaacctgttataaagcaatcagatctcatgagacttatttactaccacgagaacagtatgggagaaactgcccccatgattcaattgtcttccaccaggtccctcccacaacatgtgggaattatgggaactacaattcaagaggagatttgggtagggacacagccgaatcatatcattctgccccagctcctcccaaatttcatgtcttcacatttgaaaacaaattatgcctccccaacagtcccttaacatcttaactcatttcagtattaactcaaaagtccacagtccaaagtcttatctgagacaaggcaagtcccttccagctatgaattcataaagttaaaagcaagttagttactttccagatacaatggaggtacagggagcaggtaaacatacctgttccaaatgggtgaatttggccaaaacaaaggggctacaggccccaagtccaaaatccagcaggcctgtcaaatcttaaagctccaaaatgaactcctttgactccatgtctcacatgcaggtcacaggtcacacttatgcaagaagtgggctcccatggccttgggcagctccacccctgtggctttgcaggacatagcccccctcttggttgctttcatggactggcattgtctgtagccttcctgtgtgcatgatcaagcttttggtggctgtaccattctggggtccggaggacagtggccttcttctcacagctccagtaggcagtacctcagtggggactctgtgtgggggcttcaaccccatatttcccttctgcactgtcctagcagaggttttccattagggcaccacccctgcagcaaaattctttctggacatctaggagtttccatacatcctctgaaatctaggcagagattcccaaacctcaattcttctgtgcacccacaggctcaacaccatgtgaaactgccaaggtttggggcttgcaccacctgaatccacagcccaagctgtaccttggacccttttagccatggctagagtagctgggatgcagggcatcaagtcactaggtggcaaacagcagggggcccctgaatccagcccaggaaaccattttttccttttaggcctcttggcctgtaatgggagggactgctgcaaaggtctctgacatgtcctggagatattttccccattgtcttggtgatgaacatttgggtccttgttgcttatgcaaatttctgcagctggcttgaatttctcctcagaaaattggcttttcttttctatcacatcgtttggctgcaaattttccaaagttttatgctgtttccttttaaaactgagtgcttttaacagcacccaagtcacatcttgaatgctttgctgcttagaaatttattctgccagctaccctaaatcatctccctcaagttcaaagttccacacatctccagggcaggggcaaaatgctgccagtctctttgctaaaacatagcaagattttccttgactccagttcccaacaagttcctcatcactatctgagacaacctcagcctgaatttcattgtccatatcattattagcattttggtcaaagctagtcaacaaatctctagggagttccaaactttttcacatttttctgtctttttctgagccctccaaactgttccaacctctgcctgttacccagttccgaagttggttccacatttttggataactttacagcagcaccccactctaccagtaccaatttactgtattcatctgtttgcatgctgctgataaaggcataccaaagactgtgtgatttataaagaaaaagacgtttaatggactcacagttccatgaggctggggaggccttacttatggtgggagactaaaggcacatattacacagcagcaggcaagacagaatgaaagccaagtgaaaaaggaaatcccttataaaacaatcggatcttgtgaggcttatttactaccacaaaaacagtatggggaaaactgctcccatgattcaactatctcctactgggtccctcccataacacatgggaattatgggagctacaattcaacatgcgatttgggtggggatgcagccaaagcatatcagacctgaagagatacatttctaaaggacatacgattgacaataggtatatattaagaaaaagatgtttgccgtcactaatcatcaggaaaatgcacaatgagatatcacctcacatctattaggatggcttttataacagtaaaaaggtaacaaatgttgctgaggatattgagaaacaaaaacccttgtgcttagttgatagttgatgggaatgtaaattggtacagccattacagacaacagtatggagtttcctcaaaaaattaaaaatggaactcccatataatccagcaatcccacatctgggtatatatccaaagtaaagaaaatcactatctcagacagatatatatacttacaggtttattacagtgttatttacacagccaaggtatggaaactacctgtgtccattgacagatgaatggatgttttaaatgtattacacacacacacacacacacacacacacacacatatgtaatggaatatcatttagcctttaaaaatgaggtaatactgccatttgtaacaagatggataaacctggagtttattatggtaagtaaaataagccaggaacagatgcaaaaaaatcctgcatgatttcacttatatgcatactaagaaaatgtcaaactcatggtaacagagtaaaatagtgcttactagggcctgggagttgggggaaaagaaaaaatatttgtcagaaagtacaaactttcagttataagatgaataagttctgcagatctaatgtacagcatagtgactaaagtcaataataatgtatacttgaaatttgctgaaagagtagatctcaagtcttctccaccacacaaacacaaaaaggtaaccaggtgaggtgatgaatatgttagcttgattgtggtaatcatcacttcacaatgtatatgtatatcaaaatatcacactgcataccttaactatatacaatttttctttgttaatcaataaaactggcaaaaatatcttttacatgttgccttgactccatttcttattttgtcaaaatagatagtcctcactgtttgcataagtttagaaacttgtgctatatccagaagtcaggagtgcggtagggtgaactaagttactgattctttaggaaccttagggtgtgaggtgggactggagttcaaggtctaggagctcagtctggtcttgagcagcttcttttttgttttgttttgttttgttttgttttgagactgggtctcacattcttgcccaggctggagtgcagtggcaaaatctgggctctctgcaacctccgcctcctgggctcaagcaatcctctcacctcagcctcccatgtaacgggaaccacaggcatgtgccactagggctagcgaatttttttgtatttttggtagagatggggtttcccttgctgcccaggctggtcctgaactcctgagctcaggtgatccacccaccttggcctcccatagtgctgggattacaggtatgagccaccatgcctggccatgagcagcctcttctgatatccctagagtgttctgtacacattttctttgtctgaatgcgccttcctttctctctattggtctacagattttttccttctttaggatattattaacttgaattcaaatttttatcaaaaattggacctagctctttttattcatattttcctgctatattttttacactaatttattttcgataggttttattgagtgtttttttgacacttaaaaattttacctgacaatcttaatctttgatttatgtaattattgttccattatgacttatttctgtcatctcattttatgatttttcatactttctttactgtttattttttcctatttgtacctttcactctatagatcaaatctttttctatttgtttgaaatctggaaatttttaacattgtaatggtggttatatcattatttatgttaattttctcaatttctgatatgtgtcaaaattaatatcatctcagcaaaccagataagtgctctagcctcctctggccacctctggtttgctttctctgttacaacagcactttgtctaaggggatgctttctgaagtttactcggggtttgttttcaatatgttatgttttcatgtattttttagggtatgataaacaccactaccattgattctggaaccctcaattctaacaccacggtgtatttctcttcttagtggagtatgtcctctaagcattttcaaagggatttatttgaaataaaacttttcaggccttactttttaatgtctttttctgggctttcatatttaaaagattgtggctgcaaataattcaaggattaaaattggtttccttttaatccttgaaaaatattacttcattttattcttgtctccagcattgccgttggaaaggctgacgccaatcaaaaccaatttttccctaaaggatgatctgtcttctcatcattttgacaggatgtaacaaaacaaaggagtcttcaatgttctgagtataaatcattttgcaattataaacttaacttaaatattaatgcaatacaaaaagaattaaaaccttcttgagacatgcaagtgcacaggaaaattaagtatcatgcactcattcaggaagaaaaggtgcaaaagaaattgaatgaaagagatggtcgttagatgcaagtgtggttgaatgtagggatgcgatgctgacacgtggcagcaggcctggcaagctgtctgtcccaattcaacgacttcagaaagagaagaatattaactaggctatcttggtgatgtgctgaaaaaagtgctgtgtttcctttttaatcattcaaaacaaaggtagtaaaattcccgggaaataagaaataatgcatcataaatgtataaaagttgaggaaaatactatatttttatgaatttaaaatgccatctcatttagattgttatgtcttttcagaagtgctttaaaattgatggcatatagtaaaaaatggcataaattccaacaattaatggaaaaacattaatccatcttcttgagtcttggaaccaggattcttttgggaggcttcggtgtatctgtgtatcctttcattgccttcagacaaatcaaatcacgccacctgcgactgtggtttgaaaaaaaaagaaaacataataatgatgctgtcaattcacttgagattccatgatcaaaattaacctacgaacaaagcacagactttattataattacaaaataggatgtaatttacataaaatgtgaaaatataagcatagaacgaaatttgatacaagtcgaaagctatgacagggactgttggaggggagggaagttgtacactaatctccacatcctactgagccaatcagtggtgttcaaattggatggaccatatattatctaaacagcatattatttaagcaaagaattaagcactgtaagtatattatttagagaaagcaaatttttaaaaaatcccataaaattatatattaaagactaaattggaaatatagttttagaagaagaaagtagggtaaatgagctatgttctctaccgttcataaaaagtcaagggatattacttaaaattgttaaaacaaaattaggtgattgtataatattatttacagttcaagagaatagcatatagtaaaaaaagaaaatgataaaccttgcctaactctgaaaaacaggaccaaggtctgtggaaggaaaaaaaaattttctggttttcactggttttttgcccatgaaactgtttgaatgattttcaatgcacgtgtgttggtttaattttaaaatgttcttacttacagatccccttgaattacgtgtaaaattaggtttcctttagtcaatggtgtatgaaaagtaatcaactcatctaattgaagttagacattaataaataataaattggggagaacataaatatactcattaaaaacaaccagaacatagcacttggctctatgttctgcttatctaggaagtggaattcttaaaattaaaacaaaaaaataaggagcttcacattttctttttcttctttttttttttttttttttttttttttttttttttgagatagagtcttgctctgttgcccaggctggagtgcagtggcacgatcttggctcactgcaaccttcacctcctgggttcaagcgattctcctgcctcagcctcccgagtagctgggactacatgtgcgcatcaccacgcccagctaatttttgtatttttagtagagacggggtttcaccagattggacaggatggtctcgatctcttgaccttgtgatccacctgcctcggcctcccaacgagctgggattacaggcatgagccactgcacttggtcggagtttcacattttctaaaaaatgttagaaataaaaatgcaagtgtttcacctagataaagctctcataatcactggtagactaaagtcaatttagattaccatttatattttcaaatttataatatgaccaatattgccatgaaaatgttcaggcacagaatggtttaaagtagctgtcttattatttctcaatattctcttttcttctatgattggcatcaccaatcatggttggagcatcttttttttattttattttatttatttattttgagatggaggctcactgtgttgcccaggctggagtgcagtggcgtgatctcggctgactgcaagctccacctcccaggttctaaccattctcctgcctcagcctcccgagtagctggcactacatgtgcacgccaccattcccagctaattttttgtattttttagtagagacagaatttcaccgtgttagccaggatagtctcaatctcctgacttcgtgatctgcccgcctcagtctccaaaagtgctgggattacaggcttgagccaccgcacccagccatggttggagcatcttaccaaagaactatacttgtagtttttgagtggaaacaagggagaaattttattcatgccttgaacttattaataatgcgtaactagattctgatggccgttatcaatagaactgtcatcagattcaaagagcactgtttgtctcctctaatatggagaaatgccacaaataagtgggaaataatttaatgactgtagttcatttttaatcatatagctgagtgatattttaagtctgacaagaatagatatttgaacaaaaatagccaattctctgttacataatttaatacatttgtgttaagaggtttagacaataaagttaattttgaaatgcattataataactgagtaattagcaatcattaagttcatttttaaataagtgtttagataactaattagcaatcattaagttcatttttaaataactgtttagtccacaaaaaataaaaaatgtattttagaaagggagggcattccaaaatctgtctcaggagcattcaatctcaaatatattttaatgaagcagaaatgtaaatacatgtttagataatttaggttaaaaaaggtaaattttggttgcctgcttaacttttatgaaacagatatttttcattcaagtccagcatatattttgctatgactttcacatcctttcctcagagactatttacctaaacattagggtaccaaaggaactaggaaacaaaaacttgttagagagagaaattttaagtgaggcgcacattctggtgacattaatttgtttttgacattttattaatattttgagaacactaagaaaataaaatccaaaggggcaagcaggtatcattgtctcagcgtgggccctcttttgtcatcctctgtaagatggcagtcatcaaagagcgtgacccaagaagaaagtaaaacagtggaacaaatgagcatttctctaaatacaaacagtagagtccctgagaaagaatcctttaaggccttagatttctttaaacatttttagataaatagtctggcctatgcagaacaaaatgaaatggtgataatgaacaggatagtgaagttttgtactaactgacataaacgacgagttgattaatgcttaggatagtgtgaaagaagaattgaaagcaaaatgcaaatcaaaagaagaaatatccagacagaccctttcctaaaacatgtatcataaaatatttaaaagcatctgctttaatgcatgggctgagtcaaagtaaggcaaattttcagatatctacaagagcaaaaaaagtttgaatccagaggtgtgagtgcctcatctggcatttgccctggggtgtctcccaggaactattggcccagaaccatgagcacctaattcaggaaacagagactgatgcccatgcagggaggagtataggctaaaatgccttctgcataaatctaggatttctaaagagaagcatgttaagtggggctaggaaaatcccactcccataagaagaaagtgaaaaatctatgcttgtcttggtttcaatagggtagacaagaaaaaagaaaaaaaaatggtaatttctaaatataagtcaatagacatattggtttggatttgaattcacactatctatgggcctgagaaataccaggatggaaattagcctctggcagtgagaggttaggccagctgcacttcctgggtcgagtgcggacttggggaactttcctgtcctacaaggaatttgtaaaatgcaccaatcagcctctgtaaaacacaccaatcagcaggattctaaaagtagtcaatagtggagaggattgaaaaaagggcactctgataggacagaaacgcaacgtgggcgggaagacataaggggataaaagctggccacctgcaaccagcagcagcaaccaggtggggtcaccttccagggtgtggaagttttgttctttcgctctcagcaataaaccttcctagcctcacttttggttccgtgtcatctttaagaactgtaacactcaccaggaaggtccacagctgcattcttgaagtcagggagaccacgaacccaccggaaggaaccaactctggacacagtcctgcaaactagttaatctgagtacaatcataaagagaaatatattttgcactaatactgggaaacagattttgtaacacagctttcattgttgttaagtgaagatagtatattttacaataagcaacactgggaccactgatctccataagggaaaaaaatgaaattgaaacttaatcccggagaacaaatataaaaatatattttaacggataaagatagcttctcaacatttttagaaaaaatcctgggaagaattattttttcttttttgagatggagtcactctgttgcccaggctggagtgcagtggcgcggtctcggctcactgcaagctccacctcctctcccatgttcatgccattctcctgcttgagcctccggagtagctgggactacaggcgcccgccaccccgcctggactaattttttgtatttttagtagagacagggtttcaccgtggtagccaggatggtctcgatctcctgaccttgtgatctgcccacctcggcctcccaaagtgctgagattacaggcgtgagccaccgcgcccggccatatcttttatctttacatggggaagaagaacaaactgaaagaggaaaaattgatttgataacacaaaaatttaatacttctgtttattaaaggatactgcaaagtgaaaaaaaatacccaaaacttggcagagctatttgcaacacatcttacctagaaaggtctggtatccagaatatgcctcctataaataagtgaaaaataacatgtccgttgagaagttagcacaaatagcccataagcatgtaaaaagtgctcaacctcataataatcatgaaaatgaaaattaacaattagatatcctttcacacatattgacaatttttttttgaagttccgaaacgtgtggtattggcaaggataaagaaccatggaagtattcatcccacacgctaaagtaggacagccatttggaaaacagacagatgctggctcatacagctgatcataatgtaccctatgacccagtgacttcactacaacctagtgcaacctagtcagcctgttacaggccccagaaaaattcttgcgtttgtttacctagagatatatgagaatgttcccaattttaaaaacctggaaacaatctagttatctctcaatatgggtagatagtggactgggtaattaaatgatcatatattccaataatagagtacctcgcagcactaagagtaaatgaactgcagctattcacattctcaaatacagcactgcaatgagatactactgcatgcgtattagaatggcaaaaatccagaaccctgacaacaccaaatgctgatgaggatgtgaagcaacaggagctctcattcagtgctgatagaaatacaaaatggagaacagttttgtggcttcttagaaaactaaatctactcttattatacgacccagcaatcttgtttcttggtatatatccaaaggagttgaaaacttatgtccacacagaaacctgcacacagatgtttatggaagctttatttataattgcaaaaacttggagacaagcaagatttccttcagtaggtgaattaacaaactgtggtacatccagacaattgaatatcattcaatgataaaataaatgagctgttggccgggtgcgatggctcacgcttgtaatcccagcactttgggaggccgaggcaggcagatcacgaggtcagcacatagagaccatcctggctaccacggtgaaaccccgtcgctactaaaaatacaaaaacttagccaggtgcagtggcaggggcctgtagtcccagctacacgggaggctgaggcaggagaatggcgtgaacccgggaggtggagcttggcttgcagtgagcggagatcacgccactgccctccagcctgggcgacagagcaagactccctctaaaaaaaaaataaaaaaataaaataaataaaataaaaaataaaaagagctgtcaagccacgaaaagacacagaggacgcttatatgcatattacaaagtgaaagaagccaatctaaaacggctacatactgtcacttccaactatatgacctttctggaaaaggtaaaactatagagatagaaaaaaaaaaatcagtggtttccaggagttaggaggaagagaggaatgaataactagagcacagaggatgcgtagggccctgaaagtacatgtatgatattttaatagtgaatacttgtcattgtaaatttgtccaagcccgagtgtgaaccttaatgcaaactataagatgtatcatgtaggttctttaattgtaacaaatgcaccactctggtgggggatgtttattatgggggaggctatgcatgtgtgggggacagggagtatatgggaaatctatacctgctgctcagttttgctgtgaactttgaactgctcttaaaaataatgtgtgtatgtgtatatatatataccttctgctcagttttgctgtgaactttaaactgctctaaaaaaataatgtgtgtgtacatgtatatatatatatatgcatacacatgtttgtgtgtatgcatatctaatcacaagaaacaatacatagttggccaggcacggtggctcacgcccgtaatcccagcactttgggaggccgaggtgggtagatcacgaggtcaggagattgagaccatcctggctaacagggtgaaaccccgtctctactaaaaatacaaaaaattagccaggcatggtggcaggcgcctgtagtcccagctactccggaggctgaggcagaagaatggcgtgaacctgggagatggagctttcagtgagctgagatctcgccactgcactccagcctgggtggcagagcgagactctgtctcaacaaagaaaaaaaaaacttgtaaacaaatgatgatgaaaataagaaactgaatacaattacgaacaatgaatttaatcattagtttcttctgcattatactatatgtgaatttgttctagaaaatacaacataaaaggaaataagtaaaaaccaaatgttgagcattactaaggtaaaaatgttgaatggaatactttattatttatttatgtatttatgtatttatttgtttgtttattgagacatggttttaccctgttgcccaggctggagtgcagtggcatgaccatggctcactacagtcttgaactttcatgctcaagctatcctctgaccttagcctcctgagtagctggaactacaggtgagtgccaccatgcctggctaattaaaaataattttttttttttttgtagaaacaggctctcactatatagccagggctggtctcaaactcctgggcttaagggagactcctatcttcatctcccaaattactgggattatagatgtgagtcatcaggtgtcgcctgaatgatatattttaatgatgtacctagcacatgagtttcaaagttttcactctccaagaattttcataaggtcagtttaattattaatagcatgttttacagttatagaattaatgcataaatacagtaaaacaaaacaaaatgtgaaactatagaattgtatgaaataaaaaataagaatatttcttctgtctctatacattttccatctttaccatgttcaacatatctttattactattattataaaaaatttaagaatatacaaaaggaaataaatagcataatgaatgaatagtataagtaactcgttgacctaatacccagcttcagttttagacagtcctgattcctctgatcccacttccctgacatagattaattgaagagcatttctggcatcctatcatttcatccatgaatattttagtatccacctccaaagggtaaggatcccctttttaaaataatacatctaaaaaattagccagaattacttacttttaaccaaaatccagtcgctgttcaaatttccctgattgtcttactttttttttttttttttttttttgagatagagtcttgccctgtcacccaggctggaatgcagtggcaagatctcggctcactgcaacctccgcctcctgggttcaagcaattcttctgcctcagcttcccaattagctgggattacaggtgcccaccaccatgcctggttaattttttgtatttttagtagagacggggtttcaccatattggcatgttggtcaggcttgtcggccaggattgatctcctaacctcaagtgatccacccaccttggcctcccaaagtgttgggattacaggtgtgagccacgctgcctggccagtcttacatattttttcacaccatttttcttttttttaaaagagcagaatccttgtacggatattacgatggattgcagagtctctaaagcattcttcattcttattcttccccttccatctttttttttccatgcaattctttaaagaaactaggacagagtccacagtgtagatttttatgattgtgtcatcactgtggtgtcatttaacatgctactctgacctcagtattatctgtgaaacccacatctcaggggtgttgggcagatttgtttgcttcttgttgtgttcccaacactcagactcaggacctggtaacaatcccctatagcagttcataactatttgcttaattttgactgaacaccagagggcagtgcaggtggacaccaagagcattgctgtcaacacacagaggcctgtgggcacaggggtcctgcactgcgaggccaaagctcccttctctgctcctaagcaatccatttccctcctctgaaggacagccacatactctaggtcctaacctctggagtgcactaatgaccaagaggtgcatgagcaccaaatgtgagagtacaggagtctggaaacccagcacaggagtcttctcagaaccttaggacattcctactgttgtgagggtaggagaagaatgcctagctaaggaaacaagtgtttagtgtccaatgtgagtaagtgccatggggaagaataaagcagggaagggcaagaagatgcccagggtggacaaagaagctctcactgataaagagacattagaacacgcatctgaaggtggcgagatagtcagcctttcagatatctggagcaagcttgttgcactaagaggaaaaagcaggtgcaaaggccctggggcaggaacatgctagttttttttgaggggggcagccagctgttgtaactggaacagagagagaagggggaagatggtagtgaatgaaatctgaaaaggaacagattatgtacgatttttaggccattataaggactttggcttttactcctgtgaatcagaaagctaagtgactggggtggggtagtgctttactaagaggagtggcgctctctgataatttttaaaggatcactctggttgctgagttacaaatacatagaatgtgtcagctgggagatcaatggggaggtgattgcaatcatctggggtggctgctacaatctatgttagaaacttgcatgtttcatgccttttattctaggcaagttcatcaacatttgcttttcagatacttaatgaatctttcagtctatttagagaataaggcatgtgttgaaatgatcagtacacagtattagaaaatggaaagccatgagtataataacagagacgcctttaggggcaaagtgaggtcaggagaggaagggactgcagccagcttggcaggtgagcatggcataggacaggccttccttgagatggtcacaaatacagttttatcagttttccttgtgatggtcacaaatacagtcttatcagttttcacaaataaaaccttacaaatgttcactaataaaatgctacaacatatcgtataccatatgccaatttaagataggttttactccaatgagttaggttatctgtaaataacacatggtcaaatcccatatgtctgtgtagcaaatactttctcagtgtcctgttgtttttaatccagcatgttccaccagcctggcctaggctagggctggcacctagatagtcattagggtaagtgtgtgtttgttttggggtgtgtgtgtgtgtgtctgtgtgtgtaagactcattggctctactctcagtcccctctatcaaaatttctggaggtgggaatcaagtgtgatactgatttggaaaccacaaattcagttcacagtcttctagtccagtctgtaacagctgccttcatgacaaactgaatgttgaaagctttggaaggtgccggtaaataaaaatagaggtggagggaaagccatttcagacaaaggggatagagcactaaaaaacataagagtcagaccggattggttttgcagtgacttctgatggcctttgcaagtgttccataactggatttgcctggaatgtggggttcagggtccttggaagagagtaggtagaaataaggttttggagcgtgtgaaattagattgtggagggcctcacatgttgagcaaagaacactaaagtttattttctaggtaatagggagccaatcaaaatttttaaaatgaatgatgacaccacagaactacggttcaagaaccccacacatctgacagtcgtgtgtaataataactgttgtgttaagagtccagagatgagaaagctttctgcattcattcaggagagagggggttgggtgcttaaataggaataggccactgggatgtgtaggttggaatgaatgtgagagacagaagatgtgaacagcagaagagaaaggacaaggtccaatgtggcactggggttttaaatacaggaaattgggaggatgaaccagcagccttagcaagatacagaagaaaagagatttaggaaaaacgtagtatgggtcagccagatttggggatgctgatgccataaccaactataaccaatggaagatgatttaacacagttgtaagtatcttgaagccaatggtctgtttagatgggaaacagtctttcattttcaaatttaaaactttattcttaaaatgtgtacatttaatccagaataatctatggatatgtactgaataaatgtgttcatttttaaatttatatttgatttgtagtgtcccatttcactatagttttctgaagaaatctcagttctttatgcaaactgtatcataatagtcaagaatttaagattactttcgtgttcaaggtcctatctccaattatcctcttgtttaacatgattgccttttgacctactttccatcttaacattaacattatatttttaaattatcctgaatcaaatttcgatttaagaaactccaaaaataacaaaaattggaaacagcctataacattttaggaaatcaagaaatatatttaattgtaacacccagtttcatactccacaagagaaaaataaagcaaagcctgatcaagacgtgcctttaacacaactcaatcacctttgagccttcattctttaccagtctctctagtctctgtgcctattttctactctccctgagcagaaatttaagtgtcatattttgccaaggcctccattacatgagtaatgagtgcttacttatattgatatcccctgattttctattggtgaagtttccaggaacattcattcttttgggaggagtagagactcacgtaaaggtcatgttatgtctcttcatcttccatccttcagagactactggtggccagaacacctatgtgggagagtgggtatgggaagtggggtgtgtggataaagaaactctgttcgggagaggctcccagggatctgtgagtcagaggagtcacctatctttagggtcgcacaaatctagcaccttctatgaaaactgcattcacccagaatgtgaaaagaaaaaagggatggctgagaacttttaaaattcagcaacagacacctgcccacaaatcaaagaagctcggagaacaccagatcctactttcctactgtcataaattaggtagttttttttttaaataaaaagatagggccgggcgcggtggctcacgcctgtaatcccagcactttgggaggccgaagcaggtggatcacaaggtcaggagattgagaccatcctggctaacacggtgaaaccctgtctctactaaaaatacaaaaaaattagccgggcgtggcggcgggcacctgtagtcccagctgctggggaggctgaggcaagagaatggcgtgaacccgggaggcggagcttgcagtgagccgagatagcgccactgcactccagcctgggtgacagagcgagattctgtctcaaaaaaaaaaaaaaaaaaaagatagaaaataacattaaacttgaaggacgctttaggccaaatggacctaatagacacatacagaaacttcacccaaaagcagcagaatacacattcttctcagggacacatagaacattctgcaggatagacaacaggttagaccacaagacgaatctttgcaaatttaatattagaatcatatcaagtaccttttcagacaacaatgatatgacactagaaaccaacaatagaaggaattccagaaaatgtacgaatacgtggaaactaagcaacatggtggtgaaccaccaataggtcaatgaagaaatgaaaattaaaagaattaagcaacatgctcttgaacaaccaataggtcaatgaagaaattaaacaagaaatgtaaaaacatcttgagaaaaacaaaaatggaaacacaacataccgaaacttatgagatacagcaaaagcatttctaagaggaaagtttatagcaataaacatcaacagcaaaaagaagaaagatctcaaataaacaacttagtattacgcctcaaggaaatagaaaaaggatatcaaattctttcaatgttagcagaaggaaataaaataataaagatcagagcaaaaataagtgaaatgaaaactagaaaatgacacaaaagatgaacaaaactaagtttcttaaaaatataaaaccaataatcttttagctagactaagaaaaaaggagagaagactcaaataaataaaattagaaatgaaaaaggagacattataactgataccacaaaaatacaaaggatcataagagactgttacaattacatgcctttacaaaaatcattttttcattggcaacaacattggaaaatattacgctaaaagaaataagcgaagccaaaaaagacaaaaactgcatgttctcacttatatgtggaatctaaaacaatcaaactgtaagaagcagagagcagaatggtcattagcagaggctggaggtgtggggtggaacggatattggtcaaaaggtacaaagcctcatttatacaaaaggaataataaggttttttttctttgagatatatcgcaaaacttggtgaaaatagtacatagtaaagaattctacattttaaaaatcactaagacagtaaatttcaaatgcattccccattaaaaatgacaagtatttgaggtggtggatgttaattagcttgatataattattccaaattgtattcataaattatatcatcattttgtactccataaatatacacaactatgatttgtcaatttacaatttaaaaataaaaattaaagcacaaaacaagaaaacacaatacatgtgtgtgtacctatgcatgtgtgtgtccatagaagtgcacacacacacacccccttcacctccattactttccaaagtggacaaatgtgtaattattttgacttaggctccaaatatctaatctaattctaatatttccttgcagaattatcagtgaccacttgagaaaggaagagctagctggcagactacatcagctcaggattttttaaaaatgactttttaatttgtgtgtgtgtgtgtgtgtttgttgttgttaatgagagctggaggtaatgttcatcagcaatggaaatgaactctggcggtcaatgcttccacattgtctaaaacctgcagctgaaaataatgggcgttattcaactgtaaactatgcttatatcgtctttacatccataattctctatatcttgtgctgtctgatataagagaattcagaagaaattctcataaagcaagttgtctctttaagagttatcagtcatgtttcactagaaaagtataaaacacaaagttacaataaaatgacattatggagaaataaattcaatagatagagctgatatatat
